United States Patent 11,965,185 (LACHNOSPIRACEAE SP. CAS12A MUTANTS WITH ENHANCED CLEAVAGE ACTIVITY AT NON-CANONICAL TTTT PROTOSPACER ADJACENT MOTIFS) - sequence listing, part 4

SEQ ID NO: 2991 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagatgtataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2992 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEMYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2993 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatccggttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2994 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYPVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2995 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtctatgatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2996 - protein, 1228 aa, Artificial Sequence
  Synthetic
MSKLEKFTNCYSLSKTLRFKAIPVGKTQENIDNKRLLVYDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2997 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgatatgaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2998 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDMNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2999 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtattctcagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3000 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYSQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3001 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagattttcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3002 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQIFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3003 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgtgagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3004 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTVSGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3005 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcagaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3006 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFQKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3007 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcgcgggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3008 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIAGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3009 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagctttgcgggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3010 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFAGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3011 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgaactgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3012 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALNCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3013 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtgaaacatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3014 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVKHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3015 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcccgctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3016 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYIPLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3017 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccccggttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3018 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTPVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3019 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaataacgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3020 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNNDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3021 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgtgcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3022 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMCSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3023 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcaaacgattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3024 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFANDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3025 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgatttttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3026 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVIFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3027 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtattctgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3028 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYSVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3029 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaatcgtcatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3030 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENRHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3031 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaccacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3032 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLTTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3033 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaagatctgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3034 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEDLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3035 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggcctatgtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3036 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAYVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3037 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttgaatttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3038 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFEFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3039 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaatcttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3040 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLESFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3041 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaagtgtttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3042 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFEVFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3043 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacactgtatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3044 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTLYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3045 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtcgtaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3046 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRRKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3047 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaactattacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3048 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNYYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3049 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaaccctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3050 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKTLNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3051 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaatgtatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3052 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKMYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3053 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccctgagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3054 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTLSGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3055 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaatttacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3056 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKFTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3057 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatctctaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3058 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIISNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3059 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgaacgcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3060 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVNAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3061 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaagcgaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3062 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKANDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3063 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaatggaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3064 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKWNKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3065 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctgaccatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3066 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLTINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3067 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcaaacagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3068 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSKQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3069 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgcgtgtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3070 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLRVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3071 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccaaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3072 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAKLFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3073 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccattcttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3074 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHSYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3075 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccgtggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3076 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSRGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3077 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatctacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3078 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKSTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3079 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacgcgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3080 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINAYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3081 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaatggacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3082 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKWTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3083 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagcccgggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3084 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSPGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3085 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtcatgcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3086 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGHAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3087 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgtggtatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3088 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLWYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3089 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttaaaaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3090 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELKNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3091 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggtttatcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3092 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVYHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3093 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacagtgcctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3094 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQCLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3095 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagcgtaagaaagcagaagatgagaagctggacaaagtgaaaattgcgatcagcaataaagagtggctggaatacgcacagaccagcgttaaacat

SEQ ID NO: 3096 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQRKKAEDEKLDKVKIAISNKEWLEYAQTSVKH

SEQ ID NO: 3097 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgaatttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3098 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGEFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3099 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagctttggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3100 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSFGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3101 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggttgcctgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3102 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGCLKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3103 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcaaccgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3104 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNATANGAYNIARKVLWAIGQFKKAEDEKLDKVKIAISNKEWLEYAQTSVKH

SEQ ID NO: 3105 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacagaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3106 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTEYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3107 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgcatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3108 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPHLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3109 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagtatgtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3110 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEYVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3111 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggcctatatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3112 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAYMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3113 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaaccctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3114 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKTLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3115 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcgcgccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3116 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFAPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3117 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaacgtaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3118 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKRNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3119 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggtgggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3120 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWWAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3121 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacaactgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3122 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNNCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3123 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggcgcgaaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3124 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGAKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3125 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataacgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3126 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDNAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3127 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgtgaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3128 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTVKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3129 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgccgtggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3130 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPPWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3131 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaatatacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3132 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKYTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3133 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagggctttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3134 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKGFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3135 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatgtggaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3136 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDVESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3137 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccggatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3138 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPDVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3139 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctgggcaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3140 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLGKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3141 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtgtgcgaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3142 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVCEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3143 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtctgagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3144 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGLSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3145 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtcattttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3146 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGHFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3147 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagccaggatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3148 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSQDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3149 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgattatgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3150 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDYAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3151 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagaggtgaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3152 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEVKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3153 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaaccgcgaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3154 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTATEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3155 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgaggcggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3156 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEAVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3157 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacatctagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3158 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTSSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3159 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgaccagcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3160 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDQHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3161 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaagaaaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3162 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEENRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3163 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgatgtggatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3164 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDVDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3165 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtatgctgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3166 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRMLLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3167 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatgcggatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3168 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNADESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3169 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgcggccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3170 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNAAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3171 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttcccgatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3172 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFPIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3173 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatcagaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3174 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADQNGAYNIARKVLWAIGQFKKAEDEKLDKVKIAISNKEWLEYAQTSVKH

SEQ ID NO: 3175 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggcggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3176 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQAVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3177 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggaaaaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3178 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWEKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3179 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacatgattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3180 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNMIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3181 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatcagggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3182 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNQGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3183 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagcgtaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3184 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEERKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3185 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagtgcgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3186 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKCDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3187 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatccatgacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3188 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIHDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3189 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttctaccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3190 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGSTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3191 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaactgaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3192 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKLTDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3193 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggtgataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3194 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGDTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3195 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaaaccgtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3196 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKTVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3197 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcactgaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3198 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTALTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3199 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagctatatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3200 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISYMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3201 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgtctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3202 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLSGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3203 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaattttataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3204 - protein, 1228 aa, Artificial Sequence
  Synthetic
MSKLEKFTNCYSLSKTLRFKAIPVGKTQENIDNKRLLVEDEKRAEFYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3205 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagattttttttggggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3206 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFWGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3207 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtattatgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3208 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYYVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3209 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaaaactgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3210 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDREKLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3211 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgtataaagtgaaaattgcgatcagcaataaagagtggctggaatacgcacagaccagcgttaaacat

SEQ ID NO: 3212 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLYKVKIAISNKEWLEYAQTSVKH

SEQ ID NO: 3213 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtattatcaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3214 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYYQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3215 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagaaagagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3216 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKKEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3217 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctttgtgggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3218 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFVGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3219 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgccatccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3220 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRHPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3221 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatctgaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3222 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINLNLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3223 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaagaatacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3224 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKEYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3225 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactctatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3226 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNSISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3227 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgaccaaagtgaaaattgcgatcagcaataaagagtggctggaatacgcacagaccagcgttaaacat

SEQ ID NO: 3228 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLTKVKIAISNKEWLEYAQTSVKH

SEQ ID NO: 3229 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaaatacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3230 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRKYEAQENAILPKNADANGAYNIARKVLWAIGQFKKAEDEKLDKVKIAISNKEWLEYAQTSVKH

SEQ ID NO: 3231 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggttttgatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3232 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFDREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3233 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatctataactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3234 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIYNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3235 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtgccgaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3236 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVPKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3237 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctgtggaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3238 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELWNLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3239 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagcgtttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3240 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKAFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3241 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgaccttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3242 - protein, 1228 aa, Artificial Sequence
  Synthetic
MSKLEKFTNCYSLSKTLRFKAIPVGKTQENIDNKRLLVEDEKRAEDYKGVKKLLDRYYLTFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3243 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagactatcgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3244 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDYRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3245 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactggatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3246 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLDMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3247 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaacgtgaagatgagaagctggacaaagtgaaaattgcgatcagcaataaagagtggctggaatacgcacagaccagcgttaaacat

SEQ ID NO: 3248 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKREDEKLDKVKIAISNKEWLEYAQTSVKH

SEQ ID NO: 3249 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgtgaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3250 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIVNKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3251 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatgtataaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3252 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMYKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3253 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctgaccaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3254 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELTNLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3255 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattcgtctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3256 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIRLVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3257 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaaaccctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3258 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKTLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3259 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaatctgtgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3260 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINLCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3261 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaagatgtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3262 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKDVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3263 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatggcgttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3264 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDGVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3265 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaaaccgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3266 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKTEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3267 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgattatctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3268 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDYLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3269 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgaacgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3270 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIERGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3271 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttgcggaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3272 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVAESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3273 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttttaacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3274 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVFNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3275 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatatttgggttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3276 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIWVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3277 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccctgttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3278 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIALFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3279 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttctggagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3280 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVLEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3281 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttcgtgatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3282 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFRDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3283 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaatgaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3284 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKMTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3285 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataataaagaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3286 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNKENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3287 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgctgattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3288 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLLIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3289 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaacggcaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3290 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNGTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3291 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttctctgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3292 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFSADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3293 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacaacattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3294 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNNIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3295 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaatctgaagatgagaagctggacaaagtgaaaattgcgatcagcaataaagagtggctggaatacgcacagaccagcgttaaacat

SEQ ID NO: 3296 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKSEDEKLDKVKIAISNKEWLEYAQTSVKH

SEQ ID NO: 3297 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttggctgggcaattggccagtttaagaaagcagaagatgagaagctggacaaagtgaaaattgcgatcagcaataaagagtggctggaatacgcacagaccagcgttaaacat

SEQ ID NO: 3298 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVGWAIGQFKKAEDEKLDKVKIAISNKEWLEYAQTSVKH

SEQ ID NO: 3299 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaattgcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3300 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNCNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3301 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggcgaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3302 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLAKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3303 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatatggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3304 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDMAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3305 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgcagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3306 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPQKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3307 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgattgccgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3308 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDCRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3309 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacatgtttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3310 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNMFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3311 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgatccgcacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3312 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDPHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3313 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaaaaaaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3314 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKKKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3315 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgcggaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3316 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSAEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3317 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgttgcagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3318 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRCSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3319 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttctggagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3320 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFLEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3321 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgtttctgaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3322 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVSEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3323 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcgcgaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3324 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSAKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3325 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcactgatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3326 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSALIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3327 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttctattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3328 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGSISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3329 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagcattttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3330 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKHFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3331 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagattgtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3332 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEIVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3333 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgtgctacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3334 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLCYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3335 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtcgtaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3336 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCRTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3337 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattcaggatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3338 - protein, 1228 aa, Artificial Sequence
  Synthetic
MSKLEKFTNCYSLSKTLRFKAIPVGKTQENIDNKRLLVEDEKRAEDYKGVKKLLDRYYLSFIQDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3339 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaaggattttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3340 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKDFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3341 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataccccgattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3342 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTPIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3343 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagacctgggttaaacat

SEQ ID NO: 3344 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTWVKH

SEQ ID NO: 3345 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaacgtctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3346 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKRLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3347 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgcgtatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3348 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLRMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3349 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaactgtttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3350 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKLFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3351 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaatgtttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3352 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFEMFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3353 - DNA, 3684 bp, Artificial Sequence
  Synthetic
atgagcaaactggaaaagttcaccaactgttatagcctgagcaaaaccctgcgttgcaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3354 - protein, 1228 aa, Artificial Sequence
  Synthetic
MSKLEKFTNCYSLSKTLRCKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3355 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactggcgtatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3356 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLAYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3357 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctggcgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3358 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLAYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3359 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttaccagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3360 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFTSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3361 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcctgcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3362 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSLRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3363 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagccgctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3364 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQPLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3365 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaattttctagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3366 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFSSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3367 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccaaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3368 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTKKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3369 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaaccgtgaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3370 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTVTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3371 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgccgcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3372 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLPRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3373 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaacaggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3374 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKQDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3375 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgtgcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3376 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMCLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3377 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcgatattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3378 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSDIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3379 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaatataatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3380 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEYNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3381 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaatataaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3382 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKYKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3383 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagccagcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3384 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSQRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3385 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggtttgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3386 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWFVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3387 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgcgtaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3388 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLRKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3389 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgattctgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3390 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTILSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3391 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgttttataaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3392 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFYKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3393 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaacgcggatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3394 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNADEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3395 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctatgaaaacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3396 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYENPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3397 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacgcggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3398 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENAEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3399 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatcgtaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3400 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADRNGAYNIARKVLWAIGQFKKAEDEKLDKVKIAISNKEWLEYAQTSVKH

SEQ ID NO: 3401 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagtataccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3402 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQYTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3403 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgattctaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3404 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDSNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3405 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgaacaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3406 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLNKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3407 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggatgatgataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3408 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDDDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3409 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagcgctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3410 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEALNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3411 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgtatctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3412 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLYLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3413 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatcgtaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3414 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDRNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3415 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaacctccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3416 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKTSDGIFYDSRNYEAQENAILPKNADANGAYNIARKVLWAIGQFKKAEDEKLDKVKIAISNKEWLEYAQTSVKH

SEQ ID NO: 3417 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagtatgaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3418 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKEYENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3419 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaatgaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3420 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEMNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3421 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgcgtcagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3422 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMRQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3423 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgcgattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3424 - protein, 1228 aa, Artificial Sequence
  Synthetic
MSKLEKFTNCYSLSKTLRFKAIPVGKTQENIDNKRLLVEDEKRAEDYKGVKKLLDRDYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3425 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgattcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3426 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLIPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3427 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttccagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3428 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFQKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3429 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctctattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3430 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRSISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3431 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagaggcgaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3432 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEAKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3433 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggccatatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3434 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGHIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3435 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaccaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3436 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFTKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3437 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaacagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3438 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKQLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3439 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctctgccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3440 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPLPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3441 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgaaaaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3442 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILKKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3443 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacccgccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3444 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDPPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3445 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaactggcacagaccagcgttaaacat

SEQ ID NO: 3446 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLELAQTSVKH

SEQ ID NO: 3447 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtccgaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3448 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGPTDVDFLISPVKNSDGIFYDSRNYEAQENAILPKNADANGAYNIARKVLWAIGQFKKAEDEKLDKVKIAISNKEWLEYAQTSVKH

SEQ ID NO: 3449 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaactgatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3450 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNELINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3451 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaaccaggttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3452 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNQVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3453 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaaccatgaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3454 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENHEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3455 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttcgtctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3456 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFRLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3457 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaatctggaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3458 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNLEAQENAILPKNADANGAYNIARKVLWAIGQFKKAEDEKLDKVKIAISNKEWLEYAQTSVKH

SEQ ID NO: 3459 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatccagtacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3460 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKIQYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3461 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactttatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3462 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNFMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3463 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggcgtagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3464 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWRSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3465 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggactgcccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3466 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDCPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3467 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcggcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3468 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSGEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3469 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgtgtgagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3470 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRVSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3471 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgcgtttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3472 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPRFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3473 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggtttatgagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3474 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVYEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3475 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctgctttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3476 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKACFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3477 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattactataatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3478 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYYNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3479 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatccattacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3480 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKIHYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3481 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatgcggattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3482 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYADFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3483 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttattgggaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3484 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYWEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3485 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgcgaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3486 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFANRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3487 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaagatctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3488 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEDLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3489 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaacacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3490 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLNTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3491 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaatgctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3492 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKCCELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3493 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagatgaagaaagcagaagatgagaagctggacaaagtgaaaattgcgatcagcaataaagagtggctggaatacgcacagaccagcgttaaacat

SEQ ID NO: 3494 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQMKKAEDEKLDKVKIAISNKEWLEYAQTSVKH

SEQ ID NO: 3495 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatattggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3496 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNIGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3497 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaatgcaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3498 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKCNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3499 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagccgtaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3500 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSRNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3501 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccaggaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3502 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQETKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3503 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagtttaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3504 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQFTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3505 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatcattatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3506 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDHYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3507 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgtggatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3508 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVVDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3509 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatccgcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3510 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDPRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3511 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccgcgttggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3512 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPRWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3513 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaccccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3514 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDTPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3515 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcaaacaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3516 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTANTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3517 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaaaaaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3518 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPKKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3519 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattggcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3520 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYIGNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3521 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatttttccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3522 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYFSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3523 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacacctgggttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3524 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTWVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3525 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctttgatggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3526 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFDGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3527 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtttctggaatacgcacagaccagcgttaaacat

SEQ ID NO: 3528 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEFLEYAQTSVKH

SEQ ID NO: 3529 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaatttaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3530 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKFNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3531 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgaagtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3532 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTEVDFLISPVKNSDGIFYDSRNYEAQENAILPKNADANGAYNIARKVLWAIGQFKKAEDEKLDKVKIAISNKEWLEYAQTSVKH

SEQ ID NO: 3533 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggtatgaccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3534 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGMTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3535 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcacagggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3536 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADAQGAYNIARKVLWAIGQFKKAEDEKLDKVKIAISNKEWLEYAQTSVKH

SEQ ID NO: 3537 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatatgctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3538 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDMLLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3539 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaacatgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3540 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKHAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3541 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctgcaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3542 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKICKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3543 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgtttgaaagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3544 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFESSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3545 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccgatgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3546 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTDDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3547 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattattattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3548 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIIIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3549 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgggcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3550 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMGLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3551 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccgtggtttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3552 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPWFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3553 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaaccatgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3554 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINHEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3555 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaatctgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3556 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKSADANGAYNIARKVLWAIGQFKKAEDEKLDKVKIAISNKEWLEYAQTSVKH

SEQ ID NO: 3557 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgaatatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3558 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETEYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3559 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaactgcgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3560 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKLRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3561 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccctgtatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3562 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKALYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3563 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacctcttacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3564 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTSYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3565 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgcggcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3566 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYAAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3567 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgaacgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3568 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFERIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3569 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggccaaagatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3570 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAKDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3571 - DNA, 3684 bp, Artificial Sequence
  Synthetic
atgagcaaactggaaaagttcaccaactgttatagcctgatgaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3572 - protein, 1228 aa, Artificial Sequence
  Synthetic
MSKLEKFTNCYSLMKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3573 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgacctataaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3574 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTYKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3575 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctgccggtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3576 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLPVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3577 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccgatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3578 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSDAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3579 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcctgtatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3580 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGLYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3581 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcaccgctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3582 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADAPLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3583 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaacccagcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3584 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETQRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3585 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaacgtaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3586 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKRNKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3587 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcatcttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3588 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSSSRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3589 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagaaacgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3590 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQKRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3591 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagcgaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3592 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKAKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3593 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcatggatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3594 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGMDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3595 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgggctttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3596 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLGFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3597 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacagtgtatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3598 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTVYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3599 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccatttttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3600 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTIFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3601 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttcgtggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3602 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFRGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3603 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatcaccatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3604 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGITIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3605 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatcagtttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3606 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDQFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3607 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttaactgggcaattggccagtttaagaaagcagaagatgagaagctggacaaagtgaaaattgcgatcagcaataaagagtggctggaatacgcacagaccagcgttaaacat

SEQ ID NO: 3608 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVNWAIGQFKKAEDEKLDKVKIAISNKEWLEYAQTSVKH

SEQ ID NO: 3609 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgggcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3610 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAGFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3611 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaccgtatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3612 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTPYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3613 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggccgtgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3614 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGRDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3615 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatctgtccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3616 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYLSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3617 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaaccgtgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3618 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNRDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3619 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagattatgaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3620 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDYETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3621 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctgtctatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3622 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLSIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3623 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacaaccagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3624 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNNQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3625 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaaaactgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3626 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKKLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3627 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgtatcaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3628 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLYQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3629 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctggcgacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3630 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLATKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3631 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttccggagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3632 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFPEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3633 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgcagacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3634 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMQTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3635 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcattaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3636 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFINYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3637 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaatgctttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3638 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKCFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3639 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacaaaagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3640 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYKSNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3641 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatggcaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3642 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYGKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3643 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatataaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3644 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKYKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3645 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgcccgtgtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3646 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIARVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3647 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgattgtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3648 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPIVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3649 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgaaacgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3650 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLKRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3651 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaaatggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3652 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEMVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3653 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgcccgtagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3654 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIARSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3655 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattattgcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3656 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIIAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3657 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtgtgtatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3658 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGVYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3659 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaagattttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3660 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAEDFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3661 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgtttaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3662 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILFKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3663 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgattaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3664 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPIKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3665 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaaaaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3666 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKKTDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3667 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaacgtggatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3668 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNVDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3669 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggcccatatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3670 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAHMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3671 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacgattataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3672 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINDYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3673 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttctctaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3674 - protein, 1228 aa, Artificial Sequence
  Synthetic
MSKLEKFTNCYSLSKTLRFKAIPVGKTQENIDNKRLLVEDEKRAEDYKGVKKLLDRYYLSFSNDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3675 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtcagctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3676 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERQLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3677 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacggcgctgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3678 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTALSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3679 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagtgaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3680 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKVTNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3681 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagccataagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3682 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSHKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3683 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtcgtgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3684 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGRDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3685 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgaccgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3686 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPTEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3687 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattcattatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3688 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIHYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3689 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcccgtgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3690 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLARDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3691 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaaccgatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3692 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKPIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3693 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtgcatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3694 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQCMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3695 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgcataatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3696 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMHNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3697 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctggtgaaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3698 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLVNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3699 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaacgtggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3700 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKRGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3701 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatatgccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3702 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYMPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3703 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaaaacccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3704 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKNPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3705 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgataccgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3706 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDTDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3707 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagcttttatagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3708 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFYSASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3709 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagacccgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3710 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQTRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3711 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgaagaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3712 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSEEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3713 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcaccattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3714 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEITIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3715 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaaccgtgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3716 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINREVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3717 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagttctaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3718 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSSNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3719 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctattgcgtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3720 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYCVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3721 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagatggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3722 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKDGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3723 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagcagattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3724 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKQIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3725 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatttttataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3726 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDFYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3727 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcagaaatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3728 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAEIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3729 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaacagtacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3730 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEQYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3731 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtattgcctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3732 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYCLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3733 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcgaagataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3734 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIEDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3735 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaaggatattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3736 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKDISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3737 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggatttttttattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3738 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFFISPVKNSDGIFYDSRNYEAQENAILPKNADANGAYNIARKVLWAIGQFKKAEDEKLDKVKIAISNKEWLEYAQTSVKH

SEQ ID NO: 3739 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcacagaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3740 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESAQKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3741 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctggatgtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3742 - protein, 1228 aa, Artificial Sequence
  Synthetic
MSKLEKFTNCYSLSKTLRFKAIPVGKTQENIDNKRLDVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3743 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaacataatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3744 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEHNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3745 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgcccagctgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3746 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAQLFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3747 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccctggcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3748 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIALAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3749 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaccgatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3750 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKPIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3751 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcatcttgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3752 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYASCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3753 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatccataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3754 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAIHKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3755 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctttattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3756 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTFIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3757 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcaccaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3758 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGTNYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3759 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgttggaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3760 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRWTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3761 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgaaaaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3762 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSEKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3763 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcacccaggtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3764 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTQVDFLISPVKNSDGIFYDSRNYEAQENAILPKNADANGAYNIARKVLWAIGQFKKAEDEKLDKVKIAISNKEWLEYAQTSVKH

SEQ ID NO: 3765 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcatttatatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3766 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIYIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3767 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactctcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3768 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDSHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3769 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagttcatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3770 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVHGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3771 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtgcgtgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3772 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVREIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3773 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtatattgacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3774 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYIDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3775 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagcggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3776 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEAVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3777 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagcagctggaatacgcacagaccagcgttaaacat

SEQ ID NO: 3778 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEQLEYAQTSVKH

SEQ ID NO: 3779 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgattataaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3780 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDYKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3781 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccgcgtaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3782 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPRNSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3783 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaatctcaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3784 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVESQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3785 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaactgaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3786 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKLNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3787 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagacctttgttaaacat

SEQ ID NO: 3788 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTFVKH

SEQ ID NO: 3789 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcctgaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3790 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSLKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3791 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaagtggaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3792 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKVESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3793 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatgattatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3794 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNDYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3795 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttctgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3796 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFLSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3797 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgctgctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3798 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMLLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3799 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaacctggacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3800 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTWTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3801 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatgcagtattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3802 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMQYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3803 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcaaacgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3804 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSKRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3805 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcaaattcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3806 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIKFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3807 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgtataacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3808 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLYNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3809 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggcgtttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3810 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPAFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3811 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcgaagatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3812 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGREDVDFLISPVKNSDGIFYDSRNYEAQENAILPKNADANGAYNIARKVLWAIGQFKKAEDEKLDKVKIAISNKEWLEYAQTSVKH

SEQ ID NO: 3813 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaccaaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3814 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAITKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3815 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctgcaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3816 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFCNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3817 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactgtctgatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3818 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALSDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3819 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggcatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3820 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWHVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3821 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatctttctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3822 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYIFLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3823 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaacattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3824 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKHSDGIFYDSRNYEAQENAILPKNADANGAYNIARKVLWAIGQFKKAEDEKLDKVKIAISNKEWLEYAQTSVKH

SEQ ID NO: 3825 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggctctgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3826 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGSDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3827 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaaatgtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3828 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEMYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3829 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaacaggattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3830 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKEQDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3831 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgattataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3832 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSDYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3833 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaacgtggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3834 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQRGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3835 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattctgggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3836 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIILGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3837 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgctgaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3838 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPLKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3839 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagcgtcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3840 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQRRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3841 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatggcccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3842 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYGPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3843 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatgggcggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3844 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWAAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3845 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgtttctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3846 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMFLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3847 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctgctggaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3848 - protein, 1228 aa, Artificial Sequence
  Synthetic
MSKLEKFTNCYSLSKTLRFKAIPVGKTQENIDNKRLLLEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3849 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtgatgcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3850 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVMHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3851 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagtgatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3852 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKVIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3853 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtgtgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3854 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSVNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3855 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatctgagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3856 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYLSQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3857 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaagataaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3858 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKDKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3859 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggatattctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3860 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDILISPVKNSDGIFYDSRNYEAQENAILPKNADANGAYNIARKVLWAIGQFKKAEDEKLDKVKIAISNKEWLEYAQTSVKH

SEQ ID NO: 3861 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaaacctttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3862 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKETFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3863 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctggaagaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3864 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLEEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3865 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggccatggatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3866 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAMDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3867 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcacgtctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3868 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADARLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3869 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaagtggaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3870 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEVENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3871 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtccgattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3872 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGPIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3873 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaatgtatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3874 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTMYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3875 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattcatgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3876 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIHDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3877 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgtgcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3878 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLCGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3879 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttaaaccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3880 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVKPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3881 - DNA, 3684 bp, Artificial Sequence
  Synthetic
atgagcaaactggaaaagttcaccaactgtgatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3882 - protein, 1228 aa, Artificial Sequence
  Synthetic
MSKLEKFTNCDSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3883 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaaaagccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3884 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEKALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3885 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatcagcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3886 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDQRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3887 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtggcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3888 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGGTDVDFLISPVKNSDGIFYDSRNYEAQENAILPKNADANGAYNIARKVLWAIGQFKKAEDEKLDKVKIAISNKEWLEYAQTSVKH

SEQ ID NO: 3889 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgctggccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3890 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPLAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3891 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggaatttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3892 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVEFLISPVKNSDGIFYDSRNYEAQENAILPKNADANGAYNIARKVLWAIGQFKKAEDEKLDKVKIAISNKEWLEYAQTSVKH

SEQ ID NO: 3893 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaaaacgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3894 - protein, 1228 aa, Artificial Sequence
  Synthetic
MSKLEKFTNCYSLSKTLRFKAIPVGKTQENIDNKRLLVENEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3895 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaatttttcagtttaagaaagcagaagatgagaagctggacaaagtgaaaattgcgatcagcaataaagagtggctggaatacgcacagaccagcgttaaacat

SEQ ID NO: 3896 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIFQFKKAEDEKLDKVKIAISNKEWLEYAQTSVKH

SEQ ID NO: 3897 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttcgtgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3898 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVRDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3899 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatcagctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3900 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDQLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3901 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgaaaataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3902 - protein, 1228 aa, Artificial Sequence
  Synthetic
MSKLEKFTNCYSLSKTLRFKAIPVGKTQENIENKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3903 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatattttgatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3904 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYFDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3905 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtccgtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3906 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGPFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3907 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgtgcagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3908 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLCSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3909 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttccgccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3910 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVPPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3911 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacaggatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3912 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQDSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3913 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtgcaggagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3914 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVQEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3915 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaccgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3916 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWTVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3917 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagaatttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3918 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKEFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3919 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaacttttttggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3920 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFFGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3921 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatattattccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3922 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYYSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3923 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaaccatgaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3924 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTMTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3925 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatgcctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3926 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPECLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3927 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaaccatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3928 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNHVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3929 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaatctgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3930 - protein, 1228 aa, Artificial Sequence
  Synthetic
MSKLEKFTNCYSLSKTLRFKAIPVGKTQENIDNKRLLVESEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3931 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggcgagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3932 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLASVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3933 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcacccataaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3934 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTHKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3935 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattaacaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3936 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPINNKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3937 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgatttttctctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3938 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFSLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3939 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatcgttatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3940 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDRYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3941 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcagtgcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3942 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAVRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3943 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgtctaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3944 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLSKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3945 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatccgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3946 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDPNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3947 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaatgcctgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3948 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVECLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3949 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggcgaaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3950 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWAKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3951 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatcagtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3952 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNQCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3953 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaataaatttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3954 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNKFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3955 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtcataaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3956 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASHKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3957 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaacgcgaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3958 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNATSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3959 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctggaacgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3960 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLERKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3961 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3962 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3963 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3964 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3965 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3966 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3967 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgatctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3968 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFDLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3969 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgatttttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3970 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPIFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3971 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgtcatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3972 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRHPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3973 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3974 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3975 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3976 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3977 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgttttatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3978 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLFYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3979 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagctttgtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3980 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISFVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3981 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcagatgaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3982 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEADENAILPKNADANGAYNIARKVLWAIGQFKKAEDEKLDKVKIAISNKEWLEYAQTSVKH

SEQ ID NO: 3983 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3984 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3985 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3986 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3987 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3988 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3989 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3990 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3991 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3992 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3993 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3994 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNGFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3995 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcgtgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3996 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIVIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3997 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 3998 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3999 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcgtgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4000 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIVIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4001 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctggaacgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4002 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLERKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4003 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4004 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4005 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgcgaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4006 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIATILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4007 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcgtgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4008 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIVIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4009 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4010 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4011 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4012 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4013 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4014 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4015 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcgtgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4016 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIVIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4017 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4018 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4019 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcgtgattgccatcaataaatgcccgaaaaacatctttaagatcaacaaagaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4020 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIVIAINKCPKNIFKINKEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4021 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaaaacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatcagctgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4022 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNRFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKNIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYQLHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4023 - DNA, 43 bp, Artificial Sequence
  Synthetic
  misc_feature (21)..(22): n is a, c, g, or t
tataagaaggagatatacatnnkagcaaactggaaaagttcac

SEQ ID NO: 4024 - DNA, 43 bp, Artificial Sequence
  Synthetic
  misc_feature (21)..(22): n is a, c, g, or t
aagaaggagatatacatatgnnkaaactggaaaagttcaccaa

SEQ ID NO: 4025 - DNA, 43 bp, Artificial Sequence
  Synthetic
  misc_feature (21)..(22): n is a, c, g, or t
aaggagatatacatatgagcnnkctggaaaagttcaccaactg

SEQ ID NO: 4026 - DNA, 43 bp, Artificial Sequence
  Synthetic
  misc_feature (21)..(22): n is a, c, g, or t
gagatatacatatgagcaaannkgaaaagttcaccaactgtta

SEQ ID NO: 4027 - DNA, 43 bp, Artificial Sequence
  Synthetic
  misc_feature (21)..(22): n is a, c, g, or t
atatacatatgagcaaactgnnkaagttcaccaactgttatag

SEQ ID NO: 4028 - DNA, 43 bp, Artificial Sequence
  Synthetic
  misc_feature (21)..(22): n is a, c, g, or t
tacatatgagcaaactggaannkttcaccaactgttatagcct

SEQ ID NO: 4029 - DNA, 43 bp, Artificial Sequence
  Synthetic
  misc_feature (21)..(22): n is a, c, g, or t
atatgagcaaactggaaaagnnkaccaactgttatagcctgag

SEQ ID NO: 4030 - DNA, 43 bp, Artificial Sequence
  Synthetic
  misc_feature (21)..(22): n is a, c, g, or t
tgagcaaactggaaaagttcnnkaactgttatagcctgagcaa

SEQ ID NO: 4031 - DNA, 43 bp, Artificial Sequence
  Synthetic
  misc_feature (21)..(22): n is a, c, g, or t
gcaaactggaaaagttcaccnnktgttatagcctgagcaaaac

SEQ ID NO: 4032 - DNA, 43 bp, Artificial Sequence
  Synthetic
  misc_feature (21)..(22): n is a, c, g, or t
aactggaaaagttcaccaacnnktatagcctgagcaaaaccct

SEQ ID NO: 4033 - DNA, 43 bp, Artificial Sequence
  Synthetic
  misc_feature (21)..(22): n is a, c, g, or t
tggaaaagttcaccaactgtnnkagcctgagcaaaaccctgcg

SEQ ID NO: 4034 - DNA, 43 bp, Artificial Sequence
  Synthetic
  misc_feature (21)..(22): n is a, c, g, or t
aaaagttcaccaactgttatnnkctgagcaaaaccctgcgttt

SEQ ID NO: 4035 - DNA, 43 bp, Artificial Sequence
  Synthetic
  misc_feature (21)..(22): n is a, c, g, or t
agttcaccaactgttatagcnnkagcaaaaccctgcgttttaa

SEQ ID NO: 4036 - DNA, 43 bp, Artificial Sequence
  Synthetic
  misc_feature (21)..(22): n is a, c, g, or t
tcaccaactgttatagcctgnnkaaaaccctgcgttttaaagc

SEQ ID NO: 4037 - DNA, 43 bp, Artificial Sequence
  Synthetic
  misc_feature (21)..(22): n is a, c, g, or t
ccaactgttatagcctgagcnnkaccctgcgttttaaagcaat

SEQ ID NO: 4038 - DNA, 43 bp, Artificial Sequence
  Synthetic
  misc_feature (21)..(22): n is a, c, g, or t
actgttatagcctgagcaaannkctgcgttttaaagcaattcc

SEQ ID NO: 4039 - DNA, 43 bp, Artificial Sequence
  Synthetic
  misc_feature (21)..(22): n is a, c, g, or t
gttatagcctgagcaaaaccnnkcgttttaaagcaattccggt

SEQ ID NO: 4040 - DNA, 43 bp, Artificial Sequence
  Synthetic
  misc_feature (21)..(22): n is a, c, g, or t
atagcctgagcaaaaccctgnnktttaaagcaattccggttgg

SEQ ID NO: 4041 - DNA, 43 bp, Artificial Sequence
  Synthetic
  misc_feature (21)..(22): n is a, c, g, or t
gcctgagcaaaaccctgcgtnnkaaagcaattccggttggtaa

SEQ ID NO: 4042 - DNA, 43 bp, Artificial Sequence
  Synthetic
  misc_feature (21)..(22): n is a, c, g, or t
tgagcaaaaccctgcgttttnnkgcaattccggttggtaaaac

SEQ ID NO: 4043 - DNA, 43 bp, Artificial Sequence
  Synthetic
  misc_feature (21)..(22): n is a, c, g, or t
gcaaaaccctgcgttttaaannkattccggttggtaaaaccca

SEQ ID NO: 4044 - DNA, 43 bp, Artificial Sequence
  Synthetic
  misc_feature (21)..(22): n is a, c, g, or t
aaaccctgcgttttaaagcannkccggttggtaaaacccaaga

SEQ ID NO: 4045 - DNA, 43 bp, Artificial Sequence
  Synthetic
  misc_feature (21)..(22): n is a, c, g, or t
ccctgcgttttaaagcaattnnkgttggtaaaacccaagagaa

SEQ ID NO: 4046 - DNA, 43 bp, Artificial Sequence
  Synthetic
  misc_feature (21)..(22): n is a, c, g, or t
tgcgttttaaagcaattccgnnkggtaaaacccaagagaacat

SEQ ID NO: 4047 - DNA, 43 bp, Artificial Sequence
  Synthetic
  misc_feature (21)..(22): n is a, c, g, or t
gttttaaagcaattccggttnnkaaaacccaagagaacattga

SEQ ID NO: 4048 - DNA, 43 bp, Artificial Sequence
  Synthetic
  misc_feature (21)..(22): n is a, c, g, or t
ttaaagcaattccggttggtnnkacccaagagaacattgataa

SEQ ID NO: 4049 - DNA, 43 bp, Artificial Sequence
  Synthetic
  misc_feature (21)..(22): n is a, c, g, or t
aagcaattccggttggtaaannkcaagagaacattgataataa

SEQ ID NO: 4050 - DNA, 43 bp, Artificial Sequence
  Synthetic
  misc_feature (21)..(22): n is a, c, g, or t
caattccggttggtaaaaccnnkgagaacattgataataaacg

SEQ ID NO: 4051 - DNA, 43 bp, Artificial Sequence
  Synthetic
  misc_feature (21)..(22): n is a, c, g, or t
ttccggttggtaaaacccaannkaacattgataataaacgcct

SEQ ID NO: 4052 - DNA, 43 bp, Artificial Sequence
  Synthetic
  misc_feature (21)..(22): n is a, c, g, or t
cggttggtaaaacccaagagnnkattgataataaacgcctgct

SEQ ID NO: 4053 - DNA, 43 bp, Artificial Sequence
  Synthetic
  misc_feature (21)..(22): n is a, c, g, or t
ttggtaaaacccaagagaacnnkgataataaacgcctgctggt

SEQ ID NO: 4054 - DNA, 43 bp, Artificial Sequence
  Synthetic
  misc_feature (21)..(22): n is a, c, g, or t
gtaaaacccaagagaacattnnkaataaacgcctgctggtcga

SEQ ID NO: 4055 - DNA, 43 bp, Artificial Sequence
  Synthetic
  misc_feature (21)..(22): n is a, c, g, or t
aaacccaagagaacattgatnnkaaacgcctgctggtcgaaga

SEQ ID NO: 4056 - DNA, 43 bp, Artificial Sequence
  Synthetic
  misc_feature (21)..(22): n is a, c, g, or t
cccaagagaacattgataatnnkcgcctgctggtcgaagatga

SEQ ID NO: 4057 - DNA, 43 bp, Artificial Sequence
  Synthetic
  misc_feature (21)..(22): n is a, c, g, or t
aagagaacattgataataaannkctgctggtcgaagatgaaaa

SEQ ID NO: 4058 - DNA, 43 bp, Artificial Sequence
  Synthetic
  misc_feature (21)..(22): n is a, c, g, or t
agaacattgataataaacgcnnkctggtcgaagatgaaaaacg

SEQ ID NO: 4059 - DNA, 43 bp, Artificial Sequence
  Synthetic
  misc_feature (21)..(22): n is a, c, g, or t
acattgataataaacgcctgnnkgtcgaagatgaaaaacgcgc

SEQ ID NO: 4060 - DNA, 43 bp, Artificial Sequence
  Synthetic
  misc_feature (21)..(22): n is a, c, g, or t
ttgataataaacgcctgctgnnkgaagatgaaaaacgcgctga

SEQ ID NO: 4061 - DNA, 43 bp, Artificial Sequence
  Synthetic
  misc_feature (21)..(22): n is a, c, g, or t
ataataaacgcctgctggtcnnkgatgaaaaacgcgctgaaga

SEQ ID NO: 4062 - DNA, 43 bp, Artificial Sequence
  Synthetic
  misc_feature (21)..(22): n is a, c, g, or t
ataaacgcctgctggtcgaannkgaaaaacgcgctgaagatta

SEQ ID NO: 4063 - DNA, 43 bp, Artificial Sequence
  Synthetic
  misc_feature (21)..(22): n is a, c, g, or t
aacgcctgctggtcgaagatnnkaaacgcgctgaagattataa

SEQ ID NO: 4064 - DNA, 43 bp, Artificial Sequence
  Synthetic
  misc_feature (21)..(22): n is a, c, g, or t
gcctgctggtcgaagatgaannkcgcgctgaagattataaagg

SEQ ID NO: 4065 - DNA, 43 bp, Artificial Sequence
  Synthetic
  misc_feature (21)..(22): n is a, c, g, or t
tgctggtcgaagatgaaaaannkgctgaagattataaaggcgt

SEQ ID NO: 4066 - DNA, 43 bp, Artificial Sequence
  Synthetic
  misc_feature (21)..(22): n is a, c, g, or t
tggtcgaagatgaaaaacgcnnkgaagattataaaggcgtgaa

SEQ ID NO: 4067 - DNA, 43 bp, Artificial Sequence
  Synthetic
  misc_feature (21)..(22): n is a, c, g, or t
tcgaagatgaaaaacgcgctnnkgattataaaggcgtgaaaaa

SEQ ID NO: 4068 - DNA, 43 bp, Artificial Sequence
  Synthetic
  misc_feature (21)..(22): n is a, c, g, or t
aagatgaaaaacgcgctgaannktataaaggcgtgaaaaaact

SEQ ID NO: 4069 - DNA, 43 bp, Artificial Sequence
  Synthetic
  misc_feature (21)..(22): n is a, c, g, or t
atgaaaaacgcgctgaagatnnkaaaggcgtgaaaaaactgct

SEQ ID NO: 4070 - DNA, 43 bp, Artificial Sequence
  Synthetic
  misc_feature (21)..(22): n is a, c, g, or t
aaaaacgcgctgaagattatnnkggcgtgaaaaaactgctgga

SEQ ID NO: 4071 - DNA, 43 bp, Artificial Sequence
  Synthetic
  misc_feature (21)..(22): n is a, c, g, or t
aacgcgctgaagattataaannkgtgaaaaaactgctggatcg

SEQ ID NO: 4072 - DNA, 43 bp, Artificial Sequence
  Synthetic
  misc_feature (21)..(22): n is a, c, g, or t
gcgctgaagattataaaggcnnkaaaaaactgctggatcgcta

SEQ ID NO: 4073 - DNA, 43 bp, Artificial Sequence
  Synthetic
  misc_feature (21)..(22): n is a, c, g, or t
ctgaagattataaaggcgtgnnkaaactgctggatcgctatta

SEQ ID NO: 4074 - DNA, 43 bp, Artificial Sequence
  Synthetic
  misc_feature (21)..(22): n is a, c, g, or t
aagattataaaggcgtgaaannkctgctggatcgctattatct

SEQ ID NO: 4075 - DNA, 43 bp, Artificial Sequence
  Synthetic
  misc_feature (21)..(22): n is a, c, g, or t
attataaaggcgtgaaaaaannkctggatcgctattatctgag

SEQ ID NO: 4076 - DNA, 43 bp, Artificial Sequence
  Synthetic
  misc_feature (21)..(22): n is a, c, g, or t
ataaaggcgtgaaaaaactgnnkgatcgctattatctgagctt

SEQ ID NO: 4077 - DNA, 43 bp, Artificial Sequence
  Synthetic
  misc_feature (21)..(22): n is a, c, g, or t
aaggcgtgaaaaaactgctgnnkcgctattatctgagcttcat

SEQ ID NO: 4078 - DNA, 43 bp, Artificial Sequence
  Synthetic
  misc_feature (21)..(22): n is a, c, g, or t
gcgtgaaaaaactgctggatnnktattatctgagcttcattaa

SEQ ID NO: 4079 - DNA, 43 bp, Artificial Sequence
  Synthetic
  misc_feature (21)..(22): n is a, c, g, or t
tgaaaaaactgctggatcgcnnktatctgagcttcattaacga

SEQ ID NO: 4080 - DNA, 43 bp, Artificial Sequence
  Synthetic
  misc_feature (21)..(22): n is a, c, g, or t
aaaaactgctggatcgctatnnkctgagcttcattaacgatgt

SEQ ID NO: 4081 - DNA, 43 bp, Artificial Sequence
  Synthetic
  misc_feature (21)..(22): n is a, c, g, or t
aactgctggatcgctattatnnkagcttcattaacgatgtgct

SEQ ID NO: 4082 - DNA, 43 bp, Artificial Sequence
  Synthetic
  misc_feature (21)..(22): n is a, c, g, or t
tgctggatcgctattatctgnnkttcattaacgatgtgctgca

SEQ ID NO: 4083 - DNA, 43 bp, Artificial Sequence
  Synthetic
  misc_feature (21)..(22): n is a, c, g, or t
tggatcgctattatctgagcnnkattaacgatgtgctgcacag

SEQ ID NO: 4084 - DNA, 43 bp, Artificial Sequence
  Synthetic
  misc_feature (21)..(22): n is a, c, g, or t
atcgctattatctgagcttcnnkaacgatgtgctgcacagcat

SEQ ID NO: 4085 - DNA, 43 bp, Artificial Sequence
  Synthetic
  misc_feature (21)..(22): n is a, c, g, or t
gctattatctgagcttcattnnkgatgtgctgcacagcattaa

SEQ ID NO: 4086 - DNA, 43 bp, Artificial Sequence
  Synthetic
  misc_feature (21)..(22): n is a, c, g, or t
attatctgagcttcattaacnnkgtgctgcacagcattaaact

SEQ ID NO: 4087 - DNA, 43 bp, Artificial Sequence
  Synthetic
  misc_feature (21)..(22): n is a, c, g, or t
atctgagcttcattaacgatnnkctgcacagcattaaactgaa

SEQ ID NO: 4088 - DNA, 43 bp, Artificial Sequence
  Synthetic
  misc_feature (21)..(22): n is a, c, g, or t
tgagcttcattaacgatgtgnnkcacagcattaaactgaagaa

SEQ ID NO: 4089 - DNA, 43 bp, Artificial Sequence
  Synthetic
  misc_feature (21)..(22): n is a, c, g, or t
gcttcattaacgatgtgctgnnkagcattaaactgaagaacct

SEQ ID NO: 4090 - DNA, 43 bp, Artificial Sequence
  Synthetic
  misc_feature (21)..(22): n is a, c, g, or t
tcattaacgatgtgctgcacnnkattaaactgaagaacctgaa

SEQ ID NO: 4091 - DNA, 43 bp, Artificial Sequence
  Synthetic
  misc_feature (21)..(22): n is a, c, g, or t
ttaacgatgtgctgcacagcnnkaaactgaagaacctgaacaa

SEQ ID NO: 4092 - DNA, 43 bp, Artificial Sequence
  Synthetic
  misc_feature (21)..(22): n is a, c, g, or t
acgatgtgctgcacagcattnnkctgaagaacctgaacaacta

SEQ ID NO: 4093 - DNA, 43 bp, Artificial Sequence
  Synthetic
  misc_feature (21)..(22): n is a, c, g, or t
atgtgctgcacagcattaaannkaagaacctgaacaactatat

SEQ ID NO: 4094 - DNA, 43 bp, Artificial Sequence
  Synthetic
  misc_feature (21)..(22): n is a, c, g, or t
tgctgcacagcattaaactgnnkaacctgaacaactatatcag

SEQ ID NO: 4095 - DNA, 43 bp, Artificial Sequence
  Synthetic
  misc_feature (21)..(22): n is a, c, g, or t
tgcacagcattaaactgaagnnkctgaacaactatatcagcct

SEQ ID NO: 4096 - DNA, 43 bp, Artificial Sequence
  Synthetic
  misc_feature (21)..(22): n is a, c, g, or t
acagcattaaactgaagaacnnkaacaactatatcagcctgtt

SEQ ID NO: 4097 - DNA, 43 bp, Artificial Sequence
  Synthetic
  misc_feature (21)..(22): n is a, c, g, or t
gcattaaactgaagaacctgnnkaactatatcagcctgtttcg

SEQ ID NO: 4098 - DNA, 43 bp, Artificial Sequence
  Synthetic
  misc_feature (21)..(22): n is a, c, g, or t
ttaaactgaagaacctgaacnnktatatcagcctgtttcgtaa

SEQ ID NO: 4099 - DNA, 43 bp, Artificial Sequence
  Synthetic
  misc_feature (21)..(22): n is a, c, g, or t
aactgaagaacctgaacaacnnkatcagcctgtttcgtaaaaa

SEQ ID NO: 4100 - DNA, 43 bp, Artificial Sequence
  Synthetic
  misc_feature (21)..(22): n is a, c, g, or t
tgaagaacctgaacaactatnnkagcctgtttcgtaaaaaaac

SEQ ID NO: 4101 - DNA, 43 bp, Artificial Sequence
  Synthetic
  misc_feature (21)..(22): n is a, c, g, or t
agaacctgaacaactatatcnnkctgtttcgtaaaaaaacccg

SEQ ID NO: 4102 - DNA, 43 bp, Artificial Sequence
  Synthetic
  misc_feature (21)..(22): n is a, c, g, or t
acctgaacaactatatcagcnnktttcgtaaaaaaacccgcac

SEQ ID NO: 4103 - DNA, 43 bp, Artificial Sequence
  Synthetic
  misc_feature (21)..(22): n is a, c, g, or t
tgaacaactatatcagcctgnnkcgtaaaaaaacccgcaccga

SEQ ID NO: 4104 - DNA, 43 bp, Artificial Sequence
  Synthetic
  misc_feature (21)..(22): n is a, c, g, or t
acaactatatcagcctgtttnnkaaaaaaacccgcaccgaaaa

SEQ ID NO: 4105 - DNA, 43 bp, Artificial Sequence
  Synthetic
  misc_feature (21)..(22): n is a, c, g, or t
actatatcagcctgtttcgtnnkaaaacccgcaccgaaaaaga

SEQ ID NO: 4106 - DNA, 43 bp, Artificial Sequence
  Synthetic
  misc_feature (21)..(22): n is a, c, g, or t
atatcagcctgtttcgtaaannkacccgcaccgaaaaagaaaa

SEQ ID NO: 4107 - DNA, 43 bp, Artificial Sequence
  Synthetic
  misc_feature (21)..(22): n is a, c, g, or t
tcagcctgtttcgtaaaaaannkcgcaccgaaaaagaaaacaa

SEQ ID NO: 4108 - DNA, 43 bp, Artificial Sequence
  Synthetic
  misc_feature (21)..(22): n is a, c, g, or t
gcctgtttcgtaaaaaaaccnnkaccgaaaaagaaaacaaaga

SEQ ID NO: 4109 - DNA, 43 bp, Artificial Sequence
  Synthetic
  misc_feature (21)..(22): n is a, c, g, or t
tgtttcgtaaaaaaacccgcnnkgaaaaagaaaacaaagagct

SEQ ID NO: 4110 - DNA, 43 bp, Artificial Sequence
  Synthetic
  misc_feature (21)..(22): n is a, c, g, or t
ttcgtaaaaaaacccgcaccnnkaaagaaaacaaagagctgga

SEQ ID NO: 4111 - DNA, 43 bp, Artificial Sequence
  Synthetic
  misc_feature (21)..(22): n is a, c, g, or t
gtaaaaaaacccgcaccgaannkgaaaacaaagagctggaaaa

SEQ ID NO: 4112 - DNA, 43 bp, Artificial Sequence
  Synthetic
  misc_feature (21)..(22): n is a, c, g, or t
aaaaaacccgcaccgaaaaannkaacaaagagctggaaaacct

SEQ ID NO: 4113 - DNA, 43 bp, Artificial Sequence
  Synthetic
  misc_feature (21)..(22): n is a, c, g, or t
aaacccgcaccgaaaaagaannkaaagagctggaaaacctgga

SEQ ID NO: 4114 - DNA, 43 bp, Artificial Sequence
  Synthetic
  misc_feature (21)..(22): n is a, c, g, or t
cccgcaccgaaaaagaaaacnnkgagctggaaaacctggaaat

SEQ ID NO: 4115 - DNA, 43 bp, Artificial Sequence
  Synthetic
  misc_feature (21)..(22): n is a, c, g, or t
gcaccgaaaaagaaaacaaannkctggaaaacctggaaatcaa

SEQ ID NO: 4116 - DNA, 43 bp, Artificial Sequence
  Synthetic
  misc_feature (21)..(22): n is a, c, g, or t
ccgaaaaagaaaacaaagagnnkgaaaacctggaaatcaatct

SEQ ID NO: 4117 - DNA, 43 bp, Artificial Sequence
  Synthetic
  misc_feature (21)..(22): n is a, c, g, or t
aaaaagaaaacaaagagctgnnkaacctggaaatcaatctgcg

SEQ ID NO: 4118 - DNA, 43 bp, Artificial Sequence
  Synthetic
  misc_feature (21)..(22): n is a, c, g, or t
aagaaaacaaagagctggaannkctggaaatcaatctgcgtaa

SEQ ID NO: 4119 - DNA, 43 bp, Artificial Sequence
  Synthetic
  misc_feature (21)..(22): n is a, c, g, or t
aaaacaaagagctggaaaacnnkgaaatcaatctgcgtaaaga

SEQ ID NO: 4120 - DNA, 43 bp, Artificial Sequence
  Synthetic
  misc_feature (21)..(22): n is a, c, g, or t
acaaagagctggaaaacctgnnkatcaatctgcgtaaagaaat

SEQ ID NO: 4121 - DNA, 43 bp, Artificial Sequence
  Synthetic
  misc_feature (21)..(22): n is a, c, g, or t
aagagctggaaaacctggaannkaatctgcgtaaagaaatcgc

SEQ ID NO: 4122 - DNA, 43 bp, Artificial Sequence
  Synthetic
  misc_feature (21)..(22): n is a, c, g, or t
agctggaaaacctggaaatcnnkctgcgtaaagaaatcgccaa

SEQ ID NO: 4123 - DNA, 43 bp, Artificial Sequence
  Synthetic
  misc_feature (21)..(22): n is a, c, g, or t
tggaaaacctggaaatcaatnnkcgtaaagaaatcgccaaagc

SEQ ID NO: 4124 - DNA, 43 bp, Artificial Sequence
  Synthetic
  misc_feature (21)..(22): n is a, c, g, or t
aaaacctggaaatcaatctgnnkaaagaaatcgccaaagcgtt

SEQ ID NO: 4125 - DNA, 43 bp, Artificial Sequence
  Synthetic
  misc_feature (21)..(22): n is a, c, g, or t
acctggaaatcaatctgcgtnnkgaaatcgccaaagcgtttaa

SEQ ID NO: 4126 - DNA, 43 bp, Artificial Sequence
  Synthetic
  misc_feature (21)..(22): n is a, c, g, or t
tggaaatcaatctgcgtaaannkatcgccaaagcgtttaaagg

SEQ ID NO: 4127 - DNA, 43 bp, Artificial Sequence
  Synthetic
  misc_feature (21)..(22): n is a, c, g, or t
aaatcaatctgcgtaaagaannkgccaaagcgtttaaaggtaa

SEQ ID NO: 4128 - DNA, 43 bp, Artificial Sequence
  Synthetic
  misc_feature (21)..(22): n is a, c, g, or t
tcaatctgcgtaaagaaatcnnkaaagcgtttaaaggtaacga

SEQ ID NO: 4129 - DNA, 43 bp, Artificial Sequence
  Synthetic
  misc_feature (21)..(22): n is a, c, g, or t
atctgcgtaaagaaatcgccnnkgcgtttaaaggtaacgaggg

SEQ ID NO: 4130 - DNA, 43 bp, Artificial Sequence
  Synthetic
  misc_feature (21)..(22): n is a, c, g, or t
tgcgtaaagaaatcgccaaannktttaaaggtaacgagggtta

SEQ ID NO: 4131 - DNA, 43 bp, Artificial Sequence
  Synthetic
  misc_feature (21)..(22): n is a, c, g, or t
gtaaagaaatcgccaaagcgnnkaaaggtaacgagggttataa

SEQ ID NO: 4132 - DNA, 43 bp, Artificial Sequence
  Synthetic
  misc_feature (21)..(22): n is a, c, g, or t
aagaaatcgccaaagcgtttnnkggtaacgagggttataaaag

SEQ ID NO: 4133 - DNA, 43 bp, Artificial Sequence
  Synthetic
  misc_feature (21)..(22): n is a, c, g, or t
aaatcgccaaagcgtttaaannkaacgagggttataaaagcct

SEQ ID NO: 4134 - DNA, 43 bp, Artificial Sequence
  Synthetic
  misc_feature (21)..(22): n is a, c, g, or t
tcgccaaagcgtttaaaggtnnkgagggttataaaagcctgtt

SEQ ID NO: 4135 - DNA, 43 bp, Artificial Sequence
  Synthetic
  misc_feature (21)..(22): n is a, c, g, or t
ccaaagcgtttaaaggtaacnnkggttataaaagcctgttcaa

SEQ ID NO: 4136 - DNA, 43 bp, Artificial Sequence
  Synthetic
  misc_feature (21)..(22): n is a, c, g, or t
aagcgtttaaaggtaacgagnnktataaaagcctgttcaagaa

SEQ ID NO: 4137 - DNA, 43 bp, Artificial Sequence
  Synthetic
  misc_feature (21)..(22): n is a, c, g, or t
cgtttaaaggtaacgagggtnnkaaaagcctgttcaagaaaga

SEQ ID NO: 4138 - DNA, 43 bp, Artificial Sequence
  Synthetic
  misc_feature (21)..(22): n is a, c, g, or t
ttaaaggtaacgagggttatnnkagcctgttcaagaaagacat

SEQ ID NO: 4139 - DNA, 43 bp, Artificial Sequence
  Synthetic
  misc_feature (21)..(22): n is a, c, g, or t
aaggtaacgagggttataaannkctgttcaagaaagacatcat

SEQ ID NO: 4140 - DNA, 43 bp, Artificial Sequence
  Synthetic
  misc_feature (21)..(22): n is a, c, g, or t
gtaacgagggttataaaagcnnkttcaagaaagacatcatcga

SEQ ID NO: 4141 - DNA, 43 bp, Artificial Sequence
  Synthetic
  misc_feature (21)..(22): n is a, c, g, or t
acgagggttataaaagcctgnnkaagaaagacatcatcgaaac

SEQ ID NO: 4142 - DNA, 43 bp, Artificial Sequence
  Synthetic
  misc_feature (21)..(22): n is a, c, g, or t
agggttataaaagcctgttcnnkaaagacatcatcgaaaccat

SEQ ID NO: 4143 - DNA, 43 bp, Artificial Sequence
  Synthetic
  misc_feature (21)..(22): n is a, c, g, or t
gttataaaagcctgttcaagnnkgacatcatcgaaaccattct

SEQ ID NO: 4144 - DNA, 43 bp, Artificial Sequence
  Synthetic
  misc_feature (21)..(22): n is a, c, g, or t
ataaaagcctgttcaagaaannkatcatcgaaaccattctgcc

SEQ ID NO: 4145 - DNA, 43 bp, Artificial Sequence
  Synthetic
  misc_feature (21)..(22): n is a, c, g, or t
aaagcctgttcaagaaagacnnkatcgaaaccattctgccgga

SEQ ID NO: 4146 - DNA, 43 bp, Artificial Sequence
  Synthetic
  misc_feature (21)..(22): n is a, c, g, or t
gcctgttcaagaaagacatcnnkgaaaccattctgccggaatt

SEQ ID NO: 4147 - DNA, 43 bp, Artificial Sequence
  Synthetic
  misc_feature (21)..(22): n is a, c, g, or t
tgttcaagaaagacatcatcnnkaccattctgccggaatttct

SEQ ID NO: 4148 - DNA, 43 bp, Artificial Sequence
  Synthetic
  misc_feature (21)..(22): n is a, c, g, or t
tcaagaaagacatcatcgaannkattctgccggaatttctgga

SEQ ID NO: 4149 - DNA, 43 bp, Artificial Sequence
  Synthetic
  misc_feature (21)..(22): n is a, c, g, or t
agaaagacatcatcgaaaccnnkctgccggaatttctggatga

SEQ ID NO: 4150 - DNA, 43 bp, Artificial Sequence
  Synthetic
  misc_feature (21)..(22): n is a, c, g, or t
aagacatcatcgaaaccattnnkccggaatttctggatgataa

SEQ ID NO: 4151 - DNA, 43 bp, Artificial Sequence
  Synthetic
  misc_feature (21)..(22): n is a, c, g, or t
acatcatcgaaaccattctgnnkgaatttctggatgataaaga

SEQ ID NO: 4152 - DNA, 43 bp, Artificial Sequence
  Synthetic
  misc_feature (21)..(22): n is a, c, g, or t
tcatcgaaaccattctgccgnnktttctggatgataaagatga

SEQ ID NO: 4153 - DNA, 43 bp, Artificial Sequence
  Synthetic
  misc_feature (21)..(22): n is a, c, g, or t
tcgaaaccattctgccggaannkctggatgataaagatgaaat

SEQ ID NO: 4154 - DNA, 43 bp, Artificial Sequence
  Synthetic
  misc_feature (21)..(22): n is a, c, g, or t
aaaccattctgccggaatttnnkgatgataaagatgaaattgc

SEQ ID NO: 4155 - DNA, 43 bp, Artificial Sequence
  Synthetic
  misc_feature (21)..(22): n is a, c, g, or t
ccattctgccggaatttctgnnkgataaagatgaaattgccct

SEQ ID NO: 4156 - DNA, 43 bp, Artificial Sequence
  Synthetic
  misc_feature (21)..(22): n is a, c, g, or t
ttctgccggaatttctggatnnkaaagatgaaattgccctggt

SEQ ID NO: 4157 - DNA, 43 bp, Artificial Sequence
  Synthetic
  misc_feature (21)..(22): n is a, c, g, or t
tgccggaatttctggatgatnnkgatgaaattgccctggtgaa

SEQ ID NO: 4158 - DNA, 43 bp, Artificial Sequence
  Synthetic
  misc_feature (21)..(22): n is a, c, g, or t
cggaatttctggatgataaannkgaaattgccctggtgaatag

SEQ ID NO: 4159 - DNA, 43 bp, Artificial Sequence
  Synthetic
  misc_feature (21)..(22): n is a, c, g, or t
aatttctggatgataaagatnnkattgccctggtgaatagctt

SEQ ID NO: 4160 - DNA, 43 bp, Artificial Sequence
  Synthetic
  misc_feature (21)..(22): n is a, c, g, or t
ttctggatgataaagatgaannkgccctggtgaatagctttaa

SEQ ID NO: 4161 - DNA, 43 bp, Artificial Sequence
  Synthetic
  misc_feature (21)..(22): n is a, c, g, or t
tggatgataaagatgaaattnnkctggtgaatagctttaatgg

SEQ ID NO: 4162 - DNA, 43 bp, Artificial Sequence
  Synthetic
  misc_feature (21)..(22): n is a, c, g, or t
atgataaagatgaaattgccnnkgtgaatagctttaatggctt

SEQ ID NO: 4163 - DNA, 43 bp, Artificial Sequence
  Synthetic
  misc_feature (21)..(22): n is a, c, g, or t
ataaagatgaaattgccctgnnkaatagctttaatggctttac

SEQ ID NO: 4164 - DNA, 43 bp, Artificial Sequence
  Synthetic
  misc_feature (21)..(22): n is a, c, g, or t
aagatgaaattgccctggtgnnkagctttaatggctttaccac

SEQ ID NO: 4165 - DNA, 43 bp, Artificial Sequence
  Synthetic
  misc_feature (21)..(22): n is a, c, g, or t
atgaaattgccctggtgaatnnktttaatggctttaccaccgc

SEQ ID NO: 4166 - DNA, 43 bp, Artificial Sequence
  Synthetic
  misc_feature (21)..(22): n is a, c, g, or t
aaattgccctggtgaatagcnnkaatggctttaccaccgcatt

SEQ ID NO: 4167 - DNA, 43 bp, Artificial Sequence
  Synthetic
  misc_feature (21)..(22): n is a, c, g, or t
ttgccctggtgaatagctttnnkggctttaccaccgcatttac

SEQ ID NO: 4168 - DNA, 43 bp, Artificial Sequence
  Synthetic
  misc_feature (21)..(22): n is a, c, g, or t
ccctggtgaatagctttaatnnktttaccaccgcatttaccgg

SEQ ID NO: 4169 - DNA, 43 bp, Artificial Sequence
  Synthetic
  misc_feature (21)..(22): n is a, c, g, or t
tggtgaatagctttaatggcnnkaccaccgcatttaccggctt

SEQ ID NO: 4170 - DNA, 43 bp, Artificial Sequence
  Synthetic
  misc_feature (21)..(22): n is a, c, g, or t
tgaatagctttaatggctttnnkaccgcatttaccggcttttt

SEQ ID NO: 4171 - DNA, 43 bp, Artificial Sequence
  Synthetic
  misc_feature (21)..(22): n is a, c, g, or t
atagctttaatggctttaccnnkgcatttaccggcttttttga

SEQ ID NO: 4172 - DNA, 43 bp, Artificial Sequence
  Synthetic
  misc_feature (21)..(22): n is a, c, g, or t
gctttaatggctttaccaccnnktttaccggcttttttgataa

SEQ ID NO: 4173 - DNA, 43 bp, Artificial Sequence
  Synthetic
  misc_feature (21)..(22): n is a, c, g, or t
ttaatggctttaccaccgcannkaccggcttttttgataatcg

SEQ ID NO: 4174 - DNA, 43 bp, Artificial Sequence
  Synthetic
  misc_feature (21)..(22): n is a, c, g, or t
atggctttaccaccgcatttnnkggcttttttgataatcgcga

SEQ ID NO: 4175 - DNA, 43 bp, Artificial Sequence
  Synthetic
  misc_feature (21)..(22): n is a, c, g, or t
gctttaccaccgcatttaccnnkttttttgataatcgcgaaaa

SEQ ID NO: 4176 - DNA, 43 bp, Artificial Sequence
  Synthetic
  misc_feature (21)..(22): n is a, c, g, or t
ttaccaccgcatttaccggcnnktttgataatcgcgaaaacat

SEQ ID NO: 4177 - DNA, 43 bp, Artificial Sequence
  Synthetic
  misc_feature (21)..(22): n is a, c, g, or t
ccaccgcatttaccggctttnnkgataatcgcgaaaacatgtt

SEQ ID NO: 4178 - DNA, 43 bp, Artificial Sequence
  Synthetic
  misc_feature (21)..(22): n is a, c, g, or t
ccgcatttaccggcttttttnnkaatcgcgaaaacatgttcag

SEQ ID NO: 4179 - DNA, 43 bp, Artificial Sequence
  Synthetic
  misc_feature (21)..(22): n is a, c, g, or t
catttaccggcttttttgatnnkcgcgaaaacatgttcagcga

SEQ ID NO: 4180 - DNA, 43 bp, Artificial Sequence
  Synthetic
  misc_feature (21)..(22): n is a, c, g, or t
ttaccggcttttttgataatnnkgaaaacatgttcagcgaaga

SEQ ID NO: 4181 - DNA, 43 bp, Artificial Sequence
  Synthetic
  misc_feature (21)..(22): n is a, c, g, or t
ccggcttttttgataatcgcnnkaacatgttcagcgaagaagc

SEQ ID NO: 4182 - DNA, 43 bp, Artificial Sequence
  Synthetic
  misc_feature (21)..(22): n is a, c, g, or t
gcttttttgataatcgcgaannkatgttcagcgaagaagcaaa

SEQ ID NO: 4183 - DNA, 43 bp, Artificial Sequence
  Synthetic
  misc_feature (21)..(22): n is a, c, g, or t
tttttgataatcgcgaaaacnnkttcagcgaagaagcaaaaag

SEQ ID NO: 4184 - DNA, 43 bp, Artificial Sequence
  Synthetic
  misc_feature (21)..(22): n is a, c, g, or t
ttgataatcgcgaaaacatgnnkagcgaagaagcaaaaagcac

SEQ ID NO: 4185 - DNA, 43 bp, Artificial Sequence
  Synthetic
  misc_feature (21)..(22): n is a, c, g, or t
ataatcgcgaaaacatgttcnnkgaagaagcaaaaagcaccag

SEQ ID NO: 4186 - DNA, 43 bp, Artificial Sequence
  Synthetic
  misc_feature (21)..(22): n is a, c, g, or t
atcgcgaaaacatgttcagcnnkgaagcaaaaagcaccagcat

SEQ ID NO: 4187 - DNA, 43 bp, Artificial Sequence
  Synthetic
  misc_feature (21)..(22): n is a, c, g, or t
gcgaaaacatgttcagcgaannkgcaaaaagcaccagcattgc

SEQ ID NO: 4188 - DNA, 43 bp, Artificial Sequence
  Synthetic
  misc_feature (21)..(22): n is a, c, g, or t
aaaacatgttcagcgaagaannkaaaagcaccagcattgcatt

SEQ ID NO: 4189 - DNA, 43 bp, Artificial Sequence
  Synthetic
  misc_feature (21)..(22): n is a, c, g, or t
acatgttcagcgaagaagcannkagcaccagcattgcatttcg

SEQ ID NO: 4190 - DNA, 43 bp, Artificial Sequence
  Synthetic
  misc_feature (21)..(22): n is a, c, g, or t
tgttcagcgaagaagcaaaannkaccagcattgcatttcgctg

SEQ ID NO: 4191 - DNA, 43 bp, Artificial Sequence
  Synthetic
  misc_feature (21)..(22): n is a, c, g, or t
tcagcgaagaagcaaaaagcnnkagcattgcatttcgctgcat

SEQ ID NO: 4192 - DNA, 43 bp, Artificial Sequence
  Synthetic
  misc_feature (21)..(22): n is a, c, g, or t
gcgaagaagcaaaaagcaccnnkattgcatttcgctgcattaa

SEQ ID NO: 4193 - DNA, 43 bp, Artificial Sequence
  Synthetic
  misc_feature (21)..(22): n is a, c, g, or t
aagaagcaaaaagcaccagcnnkgcatttcgctgcattaatga

SEQ ID NO: 4194 - DNA, 43 bp, Artificial Sequence
  Synthetic
  misc_feature (21)..(22): n is a, c, g, or t
aagcaaaaagcaccagcattnnktttcgctgcattaatgaaaa

SEQ ID NO: 4195 - DNA, 43 bp, Artificial Sequence
  Synthetic
  misc_feature (21)..(22): n is a, c, g, or t
caaaaagcaccagcattgcannkcgctgcattaatgaaaatct

SEQ ID NO: 4196 - DNA, 43 bp, Artificial Sequence
  Synthetic
  misc_feature (21)..(22): n is a, c, g, or t
aaagcaccagcattgcatttnnktgcattaatgaaaatctgac

SEQ ID NO: 4197 - DNA, 43 bp, Artificial Sequence
  Synthetic
  misc_feature (21)..(22): n is a, c, g, or t
gcaccagcattgcatttcgcnnkattaatgaaaatctgacccg

SEQ ID NO: 4198 - DNA, 43 bp, Artificial Sequence
  Synthetic
  misc_feature (21)..(22): n is a, c, g, or t
ccagcattgcatttcgctgcnnkaatgaaaatctgacccgcta

SEQ ID NO: 4199 - DNA, 43 bp, Artificial Sequence
  Synthetic
  misc_feature (21)..(22): n is a, c, g, or t
gcattgcatttcgctgcattnnkgaaaatctgacccgctacat

SEQ ID NO: 4200 - DNA, 43 bp, Artificial Sequence
  Synthetic
  misc_feature (21)..(22): n is a, c, g, or t
ttgcatttcgctgcattaatnnkaatctgacccgctacattag

SEQ ID NO: 4201 - DNA, 43 bp, Artificial Sequence
  Synthetic
  misc_feature (21)..(22): n is a, c, g, or t
catttcgctgcattaatgaannkctgacccgctacattagcaa

SEQ ID NO: 4202 - DNA, 43 bp, Artificial Sequence
  Synthetic
  misc_feature (21)..(22): n is a, c, g, or t
ttcgctgcattaatgaaaatnnkacccgctacattagcaacat

SEQ ID NO: 4203 - DNA, 43 bp, Artificial Sequence
  Synthetic
  misc_feature (21)..(22): n is a, c, g, or t
gctgcattaatgaaaatctgnnkcgctacattagcaacatgga

SEQ ID NO: 4204 - DNA, 43 bp, Artificial Sequence
  Synthetic
  misc_feature (21)..(22): n is a, c, g, or t
gcattaatgaaaatctgaccnnktacattagcaacatggatat

SEQ ID NO: 4205 - DNA, 43 bp, Artificial Sequence
  Synthetic
  misc_feature (21)..(22): n is a, c, g, or t
ttaatgaaaatctgacccgcnnkattagcaacatggatatctt

SEQ ID NO: 4206 - DNA, 43 bp, Artificial Sequence
  Synthetic
  misc_feature (21)..(22): n is a, c, g, or t
atgaaaatctgacccgctacnnkagcaacatggatatctttga

SEQ ID NO: 4207 - DNA, 43 bp, Artificial Sequence
  Synthetic
  misc_feature (21)..(22): n is a, c, g, or t
aaaatctgacccgctacattnnkaacatggatatctttgaaaa

SEQ ID NO: 4208 - DNA, 43 bp, Artificial Sequence
  Synthetic
  misc_feature (21)..(22): n is a, c, g, or t
atctgacccgctacattagcnnkatggatatctttgaaaaagt

SEQ ID NO: 4209 - DNA, 43 bp, Artificial Sequence
  Synthetic
  misc_feature (21)..(22): n is a, c, g, or t
tgacccgctacattagcaacnnkgatatctttgaaaaagtgga

SEQ ID NO: 4210 - DNA, 43 bp, Artificial Sequence
  Synthetic
  misc_feature (21)..(22): n is a, c, g, or t
cccgctacattagcaacatgnnkatctttgaaaaagtggacgc

SEQ ID NO: 4211 - DNA, 43 bp, Artificial Sequence
  Synthetic
  misc_feature (21)..(22): n is a, c, g, or t
gctacattagcaacatggatnnktttgaaaaagtggacgcgat

SEQ ID NO: 4212 - DNA, 43 bp, Artificial Sequence
  Synthetic
  misc_feature (21)..(22): n is a, c, g, or t
acattagcaacatggatatcnnkgaaaaagtggacgcgatctt

SEQ ID NO: 4213 - DNA, 43 bp, Artificial Sequence
  Synthetic
  misc_feature (21)..(22): n is a, c, g, or t
ttagcaacatggatatctttnnkaaagtggacgcgatcttcga

SEQ ID NO: 4214 - DNA, 43 bp, Artificial Sequence
  Synthetic
  misc_feature (21)..(22): n is a, c, g, or t
gcaacatggatatctttgaannkgtggacgcgatcttcgataa

SEQ ID NO: 4215 - DNA, 43 bp, Artificial Sequence
  Synthetic
  misc_feature (21)..(22): n is a, c, g, or t
acatggatatctttgaaaaannkgacgcgatcttcgataaaca

SEQ ID NO: 4216 - DNA, 43 bp, Artificial Sequence
  Synthetic
  misc_feature (21)..(22): n is a, c, g, or t
tggatatctttgaaaaagtgnnkgcgatcttcgataaacacga

SEQ ID NO: 4217 - DNA, 43 bp, Artificial Sequence
  Synthetic
  misc_feature (21)..(22): n is a, c, g, or t
atatctttgaaaaagtggacnnkatcttcgataaacacgaagt

SEQ ID NO: 4218 - DNA, 43 bp, Artificial Sequence
  Synthetic
  misc_feature (21)..(22): n is a, c, g, or t
tctttgaaaaagtggacgcgnnkttcgataaacacgaagtgca

SEQ ID NO: 4219 - DNA, 43 bp, Artificial Sequence
  Synthetic
  misc_feature (21)..(22): n is a, c, g, or t
ttgaaaaagtggacgcgatcnnkgataaacacgaagtgcaaga

SEQ ID NO: 4220 - DNA, 43 bp, Artificial Sequence
  Synthetic
  misc_feature (21)..(22): n is a, c, g, or t
aaaaagtggacgcgatcttcnnkaaacacgaagtgcaagagat

SEQ ID NO: 4221 - DNA, 43 bp, Artificial Sequence
  Synthetic
  misc_feature (21)..(22): n is a, c, g, or t
aagtggacgcgatcttcgatnnkcacgaagtgcaagagatcaa

SEQ ID NO: 4222 - DNA, 43 bp, Artificial Sequence
  Synthetic
  misc_feature (21)..(22): n is a, c, g, or t
tggacgcgatcttcgataaannkgaagtgcaagagatcaaaga

SEQ ID NO: 4223 - DNA, 43 bp, Artificial Sequence
  Synthetic
  misc_feature (21)..(22): n is a, c, g, or t
acgcgatcttcgataaacacnnkgtgcaagagatcaaagagaa

SEQ ID NO: 4224 - DNA, 43 bp, Artificial Sequence
  Synthetic
  misc_feature (21)..(22): n is a, c, g, or t
cgatcttcgataaacacgaannkcaagagatcaaagagaaaat

SEQ ID NO: 4225 - DNA, 43 bp, Artificial Sequence
  Synthetic
  misc_feature (21)..(22): n is a, c, g, or t
tcttcgataaacacgaagtgnnkgagatcaaagagaaaatcct

SEQ ID NO: 4226 - DNA, 43 bp, Artificial Sequence
  Synthetic
  misc_feature (21)..(22): n is a, c, g, or t
tcgataaacacgaagtgcaannkatcaaagagaaaatcctgaa

SEQ ID NO: 4227 - DNA, 43 bp, Artificial Sequence
  Synthetic
  misc_feature (21)..(22): n is a, c, g, or t
ataaacacgaagtgcaagagnnkaaagagaaaatcctgaacag

SEQ ID NO: 4228 - DNA, 43 bp, Artificial Sequence
  Synthetic
  misc_feature (21)..(22): n is a, c, g, or t
aacacgaagtgcaagagatcnnkgagaaaatcctgaacagcga

SEQ ID NO: 4229 - DNA, 43 bp, Artificial Sequence
  Synthetic
  misc_feature (21)..(22): n is a, c, g, or t
acgaagtgcaagagatcaaannkaaaatcctgaacagcgatta

SEQ ID NO: 4230 - DNA, 43 bp, Artificial Sequence
  Synthetic
  misc_feature (21)..(22): n is a, c, g, or t
aagtgcaagagatcaaagagnnkatcctgaacagcgattatga

SEQ ID NO: 4231 - DNA, 43 bp, Artificial Sequence
  Synthetic
  misc_feature (21)..(22): n is a, c, g, or t
tgcaagagatcaaagagaaannkctgaacagcgattatgacgt

SEQ ID NO: 4232 - DNA, 43 bp, Artificial Sequence
  Synthetic
  misc_feature (21)..(22): n is a, c, g, or t
aagagatcaaagagaaaatcnnkaacagcgattatgacgtcga

SEQ ID NO: 4233 - DNA, 43 bp, Artificial Sequence
  Synthetic
  misc_feature (21)..(22): n is a, c, g, or t
agatcaaagagaaaatcctgnnkagcgattatgacgtcgaaga

SEQ ID NO: 4234 - DNA, 43 bp, Artificial Sequence
  Synthetic
  misc_feature (21)..(22): n is a, c, g, or t
tcaaagagaaaatcctgaacnnkgattatgacgtcgaagattt

SEQ ID NO: 4235 - DNA, 43 bp, Artificial Sequence
  Synthetic
  misc_feature (21)..(22): n is a, c, g, or t
aagagaaaatcctgaacagcnnktatgacgtcgaagatttttt

SEQ ID NO: 4236 - DNA, 43 bp, Artificial Sequence
  Synthetic
  misc_feature (21)..(22): n is a, c, g, or t
agaaaatcctgaacagcgatnnkgacgtcgaagatttttttga

SEQ ID NO: 4237 - DNA, 43 bp, Artificial Sequence
  Synthetic
  misc_feature (21)..(22): n is a, c, g, or t
aaatcctgaacagcgattatnnkgtcgaagatttttttgaagg

SEQ ID NO: 4238 - DNA, 43 bp, Artificial Sequence
  Synthetic
  misc_feature (21)..(22): n is a, c, g, or t
tcctgaacagcgattatgacnnkgaagatttttttgaaggcga

SEQ ID NO: 4239 - DNA, 43 bp, Artificial Sequence
  Synthetic
  misc_feature (21)..(22): n is a, c, g, or t
tgaacagcgattatgacgtcnnkgatttttttgaaggcgagtt

SEQ ID NO: 4240 - DNA, 43 bp, Artificial Sequence
  Synthetic
  misc_feature (21)..(22): n is a, c, g, or t
acagcgattatgacgtcgaannkttttttgaaggcgagttctt

SEQ ID NO: 4241 - DNA, 43 bp, Artificial Sequence
  Synthetic
  misc_feature (21)..(22): n is a, c, g, or t
gcgattatgacgtcgaagatnnktttgaaggcgagttctttaa

SEQ ID NO: 4242 - DNA, 43 bp, Artificial Sequence
  Synthetic
  misc_feature (21)..(22): n is a, c, g, or t
attatgacgtcgaagattttnnkgaaggcgagttctttaactt

SEQ ID NO: 4243 - DNA, 43 bp, Artificial Sequence
  Synthetic
  misc_feature (21)..(22): n is a, c, g, or t
atgacgtcgaagatttttttnnkggcgagttctttaacttcgt

SEQ ID NO: 4244 - DNA, 43 bp, Artificial Sequence
  Synthetic
  misc_feature (21)..(22): n is a, c, g, or t
acgtcgaagatttttttgaannkgagttctttaacttcgttct

SEQ ID NO: 4245 - DNA, 43 bp, Artificial Sequence
  Synthetic
  misc_feature (21)..(22): n is a, c, g, or t
tcgaagatttttttgaaggcnnkttctttaacttcgttctgac

SEQ ID NO: 4246 - DNA, 43 bp, Artificial Sequence
  Synthetic
  misc_feature (21)..(22): n is a, c, g, or t
aagatttttttgaaggcgagnnktttaacttcgttctgaccca

SEQ ID NO: 4247 - DNA, 43 bp, Artificial Sequence
  Synthetic
  misc_feature (21)..(22): n is a, c, g, or t
atttttttgaaggcgagttcnnkaacttcgttctgacccaaga

SEQ ID NO: 4248 - DNA, 43 bp, Artificial Sequence
  Synthetic
  misc_feature (21)..(22): n is a, c, g, or t
tttttgaaggcgagttctttnnkttcgttctgacccaagaagg

SEQ ID NO: 4249 - DNA, 43 bp, Artificial Sequence
  Synthetic
  misc_feature (21)..(22): n is a, c, g, or t
ttgaaggcgagttctttaacnnkgttctgacccaagaaggtat

SEQ ID NO: 4250 - DNA, 43 bp, Artificial Sequence
  Synthetic
  misc_feature (21)..(22): n is a, c, g, or t
aaggcgagttctttaacttcnnkctgacccaagaaggtatcga

SEQ ID NO: 4251 - DNA, 43 bp, Artificial Sequence
  Synthetic
  misc_feature (21)..(22): n is a, c, g, or t
gcgagttctttaacttcgttnnkacccaagaaggtatcgacgt

SEQ ID NO: 4252 - DNA, 43 bp, Artificial Sequence
  Synthetic
  misc_feature (21)..(22): n is a, c, g, or t
agttctttaacttcgttctgnnkcaagaaggtatcgacgttta

SEQ ID NO: 4253 - DNA, 43 bp, Artificial Sequence
  Synthetic
  misc_feature (21)..(22): n is a, c, g, or t
tctttaacttcgttctgaccnnkgaaggtatcgacgtttataa

SEQ ID NO: 4254 - DNA, 43 bp, Artificial Sequence
  Synthetic
  misc_feature (21)..(22): n is a, c, g, or t
ttaacttcgttctgacccaannkggtatcgacgtttataacgc

SEQ ID NO: 4255 - DNA, 43 bp, Artificial Sequence
  Synthetic
  misc_feature (21)..(22): n is a, c, g, or t
acttcgttctgacccaagaannkatcgacgtttataacgcaat

SEQ ID NO: 4256 - DNA, 43 bp, Artificial Sequence
  Synthetic
  misc_feature (21)..(22): n is a, c, g, or t
tcgttctgacccaagaaggtnnkgacgtttataacgcaattat

SEQ ID NO: 4257 - DNA, 43 bp, Artificial Sequence
  Synthetic
  misc_feature (21)..(22): n is a, c, g, or t
ttctgacccaagaaggtatcnnkgtttataacgcaattattgg

SEQ ID NO: 4258 - DNA, 43 bp, Artificial Sequence
  Synthetic
  misc_feature (21)..(22): n is a, c, g, or t
tgacccaagaaggtatcgacnnktataacgcaattattggtgg

SEQ ID NO: 4259 - DNA, 43 bp, Artificial Sequence
  Synthetic
  misc_feature (21)..(22): n is a, c, g, or t
cccaagaaggtatcgacgttnnkaacgcaattattggtggttt

SEQ ID NO: 4260 - DNA, 43 bp, Artificial Sequence
  Synthetic
  misc_feature (21)..(22): n is a, c, g, or t
aagaaggtatcgacgtttatnnkgcaattattggtggttttgt

SEQ ID NO: 4261 - DNA, 43 bp, Artificial Sequence
  Synthetic
  misc_feature (21)..(22): n is a, c, g, or t
aaggtatcgacgtttataacnnkattattggtggttttgttac

SEQ ID NO: 4262 - DNA, 43 bp, Artificial Sequence
  Synthetic
  misc_feature (21)..(22): n is a, c, g, or t
gtatcgacgtttataacgcannkattggtggttttgttaccga

SEQ ID NO: 4263 - DNA, 43 bp, Artificial Sequence
  Synthetic
  misc_feature (21)..(22): n is a, c, g, or t
tcgacgtttataacgcaattnnkggtggttttgttaccgaaag

SEQ ID NO: 4264 - DNA, 43 bp, Artificial Sequence
  Synthetic
  misc_feature (21)..(22): n is a, c, g, or t
acgtttataacgcaattattnnkggttttgttaccgaaagcgg

SEQ ID NO: 4265 - DNA, 43 bp, Artificial Sequence
  Synthetic
  misc_feature (21)..(22): n is a, c, g, or t
tttataacgcaattattggtnnktttgttaccgaaagcggtga

SEQ ID NO: 4266 - DNA, 43 bp, Artificial Sequence
  Synthetic
  misc_feature (21)..(22): n is a, c, g, or t
ataacgcaattattggtggtnnkgttaccgaaagcggtgagaa

SEQ ID NO: 4267 - DNA, 43 bp, Artificial Sequence
  Synthetic
  misc_feature (21)..(22): n is a, c, g, or t
acgcaattattggtggttttnnkaccgaaagcggtgagaaaat

SEQ ID NO: 4268 - DNA, 43 bp, Artificial Sequence
  Synthetic
  misc_feature (21)..(22): n is a, c, g, or t
caattattggtggttttgttnnkgaaagcggtgagaaaatcaa

SEQ ID NO: 4269 - DNA, 43 bp, Artificial Sequence
  Synthetic
  misc_feature (21)..(22): n is a, c, g, or t
ttattggtggttttgttaccnnkagcggtgagaaaatcaaagg

SEQ ID NO: 4270 - DNA, 43 bp, Artificial Sequence
  Synthetic
  misc_feature (21)..(22): n is a, c, g, or t
ttggtggttttgttaccgaannkggtgagaaaatcaaaggcct

SEQ ID NO: 4271 - DNA, 43 bp, Artificial Sequence
  Synthetic
  misc_feature (21)..(22): n is a, c, g, or t
gtggttttgttaccgaaagcnnkgagaaaatcaaaggcctgaa

SEQ ID NO: 4272 - DNA, 43 bp, Artificial Sequence
  Synthetic
  misc_feature (21)..(22): n is a, c, g, or t
gttttgttaccgaaagcggtnnkaaaatcaaaggcctgaatga

SEQ ID NO: 4273 - DNA, 43 bp, Artificial Sequence
  Synthetic
  misc_feature (21)..(22): n is a, c, g, or t
ttgttaccgaaagcggtgagnnkatcaaaggcctgaatgaata

SEQ ID NO: 4274 - DNA, 43 bp, Artificial Sequence
  Synthetic
  misc_feature (21)..(22): n is a, c, g, or t
ttaccgaaagcggtgagaaannkaaaggcctgaatgaatatat

SEQ ID NO: 4275 - DNA, 43 bp, Artificial Sequence
  Synthetic
  misc_feature (21)..(22): n is a, c, g, or t
ccgaaagcggtgagaaaatcnnkggcctgaatgaatatatcaa

SEQ ID NO: 4276 - DNA, 43 bp, Artificial Sequence
  Synthetic
  misc_feature (21)..(22): n is a, c, g, or t
aaagcggtgagaaaatcaaannkctgaatgaatatatcaacct

SEQ ID NO: 4277 - DNA, 43 bp, Artificial Sequence
  Synthetic
  misc_feature (21)..(22): n is a, c, g, or t
gcggtgagaaaatcaaaggcnnkaatgaatatatcaacctgta

SEQ ID NO: 4278 - DNA, 43 bp, Artificial Sequence
  Synthetic
  misc_feature (21)..(22): n is a, c, g, or t
gtgagaaaatcaaaggcctgnnkgaatatatcaacctgtataa

SEQ ID NO: 4279 - DNA, 43 bp, Artificial Sequence
  Synthetic
  misc_feature (21)..(22): n is a, c, g, or t
agaaaatcaaaggcctgaatnnktatatcaacctgtataacca

SEQ ID NO: 4280 - DNA, 43 bp, Artificial Sequence
  Synthetic
  misc_feature (21)..(22): n is a, c, g, or t
aaatcaaaggcctgaatgaannkatcaacctgtataaccagaa

SEQ ID NO: 4281 - DNA, 43 bp, Artificial Sequence
  Synthetic
  misc_feature (21)..(22): n is a, c, g, or t
tcaaaggcctgaatgaatatnnkaacctgtataaccagaaaac

SEQ ID NO: 4282 - DNA, 43 bp, Artificial Sequence
  Synthetic
  misc_feature (21)..(22): n is a, c, g, or t
aaggcctgaatgaatatatcnnkctgtataaccagaaaaccaa

SEQ ID NO: 4283 - DNA, 43 bp, Artificial Sequence
  Synthetic
  misc_feature (21)..(22): n is a, c, g, or t
gcctgaatgaatatatcaacnnktataaccagaaaaccaaaca

SEQ ID NO: 4284 - DNA, 43 bp, Artificial Sequence
  Synthetic
  misc_feature (21)..(22): n is a, c, g, or t
tgaatgaatatatcaacctgnnkaaccagaaaaccaaacagaa

SEQ ID NO: 4285 - DNA, 43 bp, Artificial Sequence
  Synthetic
  misc_feature (21)..(22): n is a, c, g, or t
atgaatatatcaacctgtatnnkcagaaaaccaaacagaaact

SEQ ID NO: 4286 - DNA, 43 bp, Artificial Sequence
  Synthetic
  misc_feature (21)..(22): n is a, c, g, or t
aatatatcaacctgtataacnnkaaaaccaaacagaaactgcc

SEQ ID NO: 4287 - DNA, 43 bp, Artificial Sequence
  Synthetic
  misc_feature (21)..(22): n is a, c, g, or t
atatcaacctgtataaccagnnkaccaaacagaaactgccgaa

SEQ ID NO: 4288 - DNA, 43 bp, Artificial Sequence
  Synthetic
  misc_feature (21)..(22): n is a, c, g, or t
tcaacctgtataaccagaaannkaaacagaaactgccgaaatt

SEQ ID NO: 4289 - DNA, 43 bp, Artificial Sequence
  Synthetic
  misc_feature (21)..(22): n is a, c, g, or t
acctgtataaccagaaaaccnnkcagaaactgccgaaattcaa

SEQ ID NO: 4290 - DNA, 43 bp, Artificial Sequence
  Synthetic
  misc_feature (21)..(22): n is a, c, g, or t
tgtataaccagaaaaccaaannkaaactgccgaaattcaaacc

SEQ ID NO: 4291 - DNA, 43 bp, Artificial Sequence
  Synthetic
  misc_feature (21)..(22): n is a, c, g, or t
ataaccagaaaaccaaacagnnkctgccgaaattcaaaccgct

SEQ ID NO: 4292 - DNA, 43 bp, Artificial Sequence
  Synthetic
  misc_feature (21)..(22): n is a, c, g, or t
accagaaaaccaaacagaaannkccgaaattcaaaccgctgta

SEQ ID NO: 4293 - DNA, 43 bp, Artificial Sequence
  Synthetic
  misc_feature (21)..(22): n is a, c, g, or t
agaaaaccaaacagaaactgnnkaaattcaaaccgctgtataa

SEQ ID NO: 4294 - DNA, 43 bp, Artificial Sequence
  Synthetic
  misc_feature (21)..(22): n is a, c, g, or t
aaaccaaacagaaactgccgnnkttcaaaccgctgtataaaca

SEQ ID NO: 4295 - DNA, 43 bp, Artificial Sequence
  Synthetic
  misc_feature (21)..(22): n is a, c, g, or t
ccaaacagaaactgccgaaannkaaaccgctgtataaacaggt

SEQ ID NO: 4296 - DNA, 43 bp, Artificial Sequence
  Synthetic
  misc_feature (21)..(22): n is a, c, g, or t
aacagaaactgccgaaattcnnkccgctgtataaacaggttct

SEQ ID NO: 4297 - DNA, 43 bp, Artificial Sequence
  Synthetic
  misc_feature (21)..(22): n is a, c, g, or t
agaaactgccgaaattcaaannkctgtataaacaggttctgag

SEQ ID NO: 4298 - DNA, 43 bp, Artificial Sequence
  Synthetic
  misc_feature (21)..(22): n is a, c, g, or t
aactgccgaaattcaaaccgnnktataaacaggttctgagcga

SEQ ID NO: 4299 - DNA, 43 bp, Artificial Sequence
  Synthetic
  misc_feature (21)..(22): n is a, c, g, or t
tgccgaaattcaaaccgctgnnkaaacaggttctgagcgatcg

SEQ ID NO: 4300 - DNA, 43 bp, Artificial Sequence
  Synthetic
  misc_feature (21)..(22): n is a, c, g, or t
cgaaattcaaaccgctgtatnnkcaggttctgagcgatcgtga

SEQ ID NO: 4301 - DNA, 43 bp, Artificial Sequence
  Synthetic
  misc_feature (21)..(22): n is a, c, g, or t
aattcaaaccgctgtataaannkgttctgagcgatcgtgaaag

SEQ ID NO: 4302 - DNA, 43 bp, Artificial Sequence
  Synthetic
  misc_feature (21)..(22): n is a, c, g, or t
tcaaaccgctgtataaacagnnkctgagcgatcgtgaaagcct

SEQ ID NO: 4303 - DNA, 43 bp, Artificial Sequence
  Synthetic
  misc_feature (21)..(22): n is a, c, g, or t
aaccgctgtataaacaggttnnkagcgatcgtgaaagcctgag

SEQ ID NO: 4304 - DNA, 43 bp, Artificial Sequence
  Synthetic
  misc_feature (21)..(22): n is a, c, g, or t
cgctgtataaacaggttctgnnkgatcgtgaaagcctgagctt

SEQ ID NO: 4305 - DNA, 43 bp, Artificial Sequence
  Synthetic
  misc_feature (21)..(22): n is a, c, g, or t
tgtataaacaggttctgagcnnkcgtgaaagcctgagctttta

SEQ ID NO: 4306 - DNA, 43 bp, Artificial Sequence
  Synthetic
  misc_feature (21)..(22): n is a, c, g, or t
ataaacaggttctgagcgatnnkgaaagcctgagcttttatgg

SEQ ID NO: 4307 - DNA, 43 bp, Artificial Sequence
  Synthetic
  misc_feature (21)..(22): n is a, c, g, or t
aacaggttctgagcgatcgtnnkagcctgagcttttatggtga

SEQ ID NO: 4308 - DNA, 43 bp, Artificial Sequence
  Synthetic
  misc_feature (21)..(22): n is a, c, g, or t
aggttctgagcgatcgtgaannkctgagcttttatggtgaagg

SEQ ID NO: 4309 - DNA, 43 bp, Artificial Sequence
  Synthetic
  misc_feature (21)..(22): n is a, c, g, or t
ttctgagcgatcgtgaaagcnnkagcttttatggtgaaggtta

SEQ ID NO: 4310 - DNA, 43 bp, Artificial Sequence
  Synthetic
  misc_feature (21)..(22): n is a, c, g, or t
tgagcgatcgtgaaagcctgnnkttttatggtgaaggttatac

SEQ ID NO: 4311 - DNA, 43 bp, Artificial Sequence
  Synthetic
  misc_feature (21)..(22): n is a, c, g, or t
gcgatcgtgaaagcctgagcnnktatggtgaaggttataccag

SEQ ID NO: 4312 - DNA, 43 bp, Artificial Sequence
  Synthetic
  misc_feature (21)..(22): n is a, c, g, or t
atcgtgaaagcctgagctttnnkggtgaaggttataccagtga

SEQ ID NO: 4313 - DNA, 43 bp, Artificial Sequence
  Synthetic
  misc_feature (21)..(22): n is a, c, g, or t
gtgaaagcctgagcttttatnnkgaaggttataccagtgatga

SEQ ID NO: 4314 - DNA, 43 bp, Artificial Sequence
  Synthetic
  misc_feature (21)..(22): n is a, c, g, or t
aaagcctgagcttttatggtnnkggttataccagtgatgaaga

SEQ ID NO: 4315 - DNA, 43 bp, Artificial Sequence
  Synthetic
  misc_feature (21)..(22): n is a, c, g, or t
gcctgagcttttatggtgaannktataccagtgatgaagaggt

SEQ ID NO: 4316 - DNA, 43 bp, Artificial Sequence
  Synthetic
  misc_feature (21)..(22): n is a, c, g, or t
tgagcttttatggtgaaggtnnkaccagtgatgaagaggttct

SEQ ID NO: 4317 - DNA, 43 bp, Artificial Sequence
  Synthetic
  misc_feature (21)..(22): n is a, c, g, or t
gcttttatggtgaaggttatnnkagtgatgaagaggttctgga

SEQ ID NO: 4318 - DNA, 43 bp, Artificial Sequence
  Synthetic
  misc_feature (21)..(22): n is a, c, g, or t
tttatggtgaaggttataccnnkgatgaagaggttctggaagt

SEQ ID NO: 4319 - DNA, 43 bp, Artificial Sequence
  Synthetic
  misc_feature (21)..(22): n is a, c, g, or t
atggtgaaggttataccagtnnkgaagaggttctggaagtttt

SEQ ID NO: 4320 - DNA, 43 bp, Artificial Sequence
  Synthetic
  misc_feature (21)..(22): n is a, c, g, or t
gtgaaggttataccagtgatnnkgaggttctggaagtttttcg

SEQ ID NO: 4321 - DNA, 43 bp, Artificial Sequence
  Synthetic
  misc_feature (21)..(22): n is a, c, g, or t
aaggttataccagtgatgaannkgttctggaagtttttcgtaa

SEQ ID NO: 4322 - DNA, 43 bp, Artificial Sequence
  Synthetic
  misc_feature (21)..(22): n is a, c, g, or t
gttataccagtgatgaagagnnkctggaagtttttcgtaacac

SEQ ID NO: 4323 - DNA, 43 bp, Artificial Sequence
  Synthetic
  misc_feature (21)..(22): n is a, c, g, or t
ataccagtgatgaagaggttnnkgaagtttttcgtaacaccct

SEQ ID NO: 4324 - DNA, 43 bp, Artificial Sequence
  Synthetic
  misc_feature (21)..(22): n is a, c, g, or t
ccagtgatgaagaggttctgnnkgtttttcgtaacaccctgaa

SEQ ID NO: 4325 - DNA, 43 bp, Artificial Sequence
  Synthetic
  misc_feature (21)..(22): n is a, c, g, or t
gtgatgaagaggttctggaannktttcgtaacaccctgaataa

SEQ ID NO: 4326 - DNA, 43 bp, Artificial Sequence
  Synthetic
  misc_feature (21)..(22): n is a, c, g, or t
atgaagaggttctggaagttnnkcgtaacaccctgaataaaaa

SEQ ID NO: 4327 - DNA, 43 bp, Artificial Sequence
  Synthetic
  misc_feature (21)..(22): n is a, c, g, or t
aagaggttctggaagtttttnnkaacaccctgaataaaaacag

SEQ ID NO: 4328 - DNA, 43 bp, Artificial Sequence
  Synthetic
  misc_feature (21)..(22): n is a, c, g, or t
aggttctggaagtttttcgtnnkaccctgaataaaaacagcga

SEQ ID NO: 4329 - DNA, 43 bp, Artificial Sequence
  Synthetic
  misc_feature (21)..(22): n is a, c, g, or t
ttctggaagtttttcgtaacnnkctgaataaaaacagcgagat

SEQ ID NO: 4330 - DNA, 43 bp, Artificial Sequence
  Synthetic
  misc_feature (21)..(22): n is a, c, g, or t
tggaagtttttcgtaacaccnnkaataaaaacagcgagatctt

SEQ ID NO: 4331 - DNA, 43 bp, Artificial Sequence
  Synthetic
  misc_feature (21)..(22): n is a, c, g, or t
aagtttttcgtaacaccctgnnkaaaaacagcgagatctttag

SEQ ID NO: 4332 - DNA, 43 bp, Artificial Sequence
  Synthetic
  misc_feature (21)..(22): n is a, c, g, or t
tttttcgtaacaccctgaatnnkaacagcgagatctttagcag

SEQ ID NO: 4333 - DNA, 43 bp, Artificial Sequence
  Synthetic
  misc_feature (21)..(22): n is a, c, g, or t
ttcgtaacaccctgaataaannkagcgagatctttagcagcat

SEQ ID NO: 4334 - DNA, 43 bp, Artificial Sequence
  Synthetic
  misc_feature (21)..(22): n is a, c, g, or t
gtaacaccctgaataaaaacnnkgagatctttagcagcatcaa

SEQ ID NO: 4335 - DNA, 43 bp, Artificial Sequence
  Synthetic
  misc_feature (21)..(22): n is a, c, g, or t
acaccctgaataaaaacagcnnkatctttagcagcatcaaaaa

SEQ ID NO: 4336 - DNA, 43 bp, Artificial Sequence
  Synthetic
  misc_feature (21)..(22): n is a, c, g, or t
ccctgaataaaaacagcgagnnktttagcagcatcaaaaagct

SEQ ID NO: 4337 - DNA, 43 bp, Artificial Sequence
  Synthetic
  misc_feature (21)..(22): n is a, c, g, or t
tgaataaaaacagcgagatcnnkagcagcatcaaaaagcttga

SEQ ID NO: 4338 - DNA, 43 bp, Artificial Sequence
  Synthetic
  misc_feature (21)..(22): n is a, c, g, or t
ataaaaacagcgagatctttnnkagcatcaaaaagcttgagaa

SEQ ID NO: 4339 - DNA, 43 bp, Artificial Sequence
  Synthetic
  misc_feature (21)..(22): n is a, c, g, or t
aaaacagcgagatctttagcnnkatcaaaaagcttgagaaact

SEQ ID NO: 4340 - DNA, 43 bp, Artificial Sequence
  Synthetic
  misc_feature (21)..(22): n is a, c, g, or t
acagcgagatctttagcagcnnkaaaaagcttgagaaactgtt

SEQ ID NO: 4341 - DNA, 43 bp, Artificial Sequence
  Synthetic
  misc_feature (21)..(22): n is a, c, g, or t
gcgagatctttagcagcatcnnkaagcttgagaaactgttcaa

SEQ ID NO: 4342 - DNA, 43 bp, Artificial Sequence
  Synthetic
  misc_feature (21)..(22): n is a, c, g, or t
agatctttagcagcatcaaannkcttgagaaactgttcaaaaa

SEQ ID NO: 4343 - DNA, 43 bp, Artificial Sequence
  Synthetic
  misc_feature (21)..(22): n is a, c, g, or t
tctttagcagcatcaaaaagnnkgagaaactgttcaaaaactt

SEQ ID NO: 4344 - DNA, 43 bp, Artificial Sequence
  Synthetic
  misc_feature (21)..(22): n is a, c, g, or t
ttagcagcatcaaaaagcttnnkaaactgttcaaaaactttga

SEQ ID NO: 4345 - DNA, 43 bp, Artificial Sequence
  Synthetic
  misc_feature (21)..(22): n is a, c, g, or t
gcagcatcaaaaagcttgagnnkctgttcaaaaactttgatga

SEQ ID NO: 4346 - DNA, 43 bp, Artificial Sequence
  Synthetic
  misc_feature (21)..(22): n is a, c, g, or t
gcatcaaaaagcttgagaaannkttcaaaaactttgatgagta

SEQ ID NO: 4347 - DNA, 43 bp, Artificial Sequence
  Synthetic
  misc_feature (21)..(22): n is a, c, g, or t
tcaaaaagcttgagaaactgnnkaaaaactttgatgagtatag

SEQ ID NO: 4348 - DNA, 43 bp, Artificial Sequence
  Synthetic
  misc_feature (21)..(22): n is a, c, g, or t
aaaagcttgagaaactgttcnnkaactttgatgagtatagcag

SEQ ID NO: 4349 - DNA, 43 bp, Artificial Sequence
  Synthetic
  misc_feature (21)..(22): n is a, c, g, or t
agcttgagaaactgttcaaannktttgatgagtatagcagcgc

SEQ ID NO: 4350 - DNA, 43 bp, Artificial Sequence
  Synthetic
  misc_feature (21)..(22): n is a, c, g, or t
ttgagaaactgttcaaaaacnnkgatgagtatagcagcgcagg

SEQ ID NO: 4351 - DNA, 43 bp, Artificial Sequence
  Synthetic
  misc_feature (21)..(22): n is a, c, g, or t
agaaactgttcaaaaactttnnkgagtatagcagcgcaggcat

SEQ ID NO: 4352 - DNA, 43 bp, Artificial Sequence
  Synthetic
  misc_feature (21)..(22): n is a, c, g, or t
aactgttcaaaaactttgatnnktatagcagcgcaggcatctt

SEQ ID NO: 4353 - DNA, 43 bp, Artificial Sequence
  Synthetic
  misc_feature (21)..(22): n is a, c, g, or t
tgttcaaaaactttgatgagnnkagcagcgcaggcatctttgt

SEQ ID NO: 4354 - DNA, 43 bp, Artificial Sequence
  Synthetic
  misc_feature (21)..(22): n is a, c, g, or t
tcaaaaactttgatgagtatnnkagcgcaggcatctttgttaa

SEQ ID NO: 4355 - DNA, 43 bp, Artificial Sequence
  Synthetic
  misc_feature (21)..(22): n is a, c, g, or t
aaaactttgatgagtatagcnnkgcaggcatctttgttaaaaa

SEQ ID NO: 4356 - DNA, 43 bp, Artificial Sequence
  Synthetic
  misc_feature (21)..(22): n is a, c, g, or t
actttgatgagtatagcagcnnkggcatctttgttaaaaatgg

SEQ ID NO: 4357 - DNA, 43 bp, Artificial Sequence
  Synthetic
  misc_feature (21)..(22): n is a, c, g, or t
ttgatgagtatagcagcgcannkatctttgttaaaaatggtcc

SEQ ID NO: 4358 - DNA, 43 bp, Artificial Sequence
  Synthetic
  misc_feature (21)..(22): n is a, c, g, or t
atgagtatagcagcgcaggcnnktttgttaaaaatggtccggc

SEQ ID NO: 4359 - DNA, 43 bp, Artificial Sequence
  Synthetic
  misc_feature (21)..(22): n is a, c, g, or t
agtatagcagcgcaggcatcnnkgttaaaaatggtccggcaat

SEQ ID NO: 4360 - DNA, 43 bp, Artificial Sequence
  Synthetic
  misc_feature (21)..(22): n is a, c, g, or t
atagcagcgcaggcatctttnnkaaaaatggtccggcaattag

SEQ ID NO: 4361 - DNA, 43 bp, Artificial Sequence
  Synthetic
  misc_feature (21)..(22): n is a, c, g, or t
gcagcgcaggcatctttgttnnkaatggtccggcaattagcac

SEQ ID NO: 4362 - DNA, 43 bp, Artificial Sequence
  Synthetic
  misc_feature (21)..(22): n is a, c, g, or t
gcgcaggcatctttgttaaannkggtccggcaattagcaccat

SEQ ID NO: 4363 - DNA, 43 bp, Artificial Sequence
  Synthetic
  misc_feature (21)..(22): n is a, c, g, or t
caggcatctttgttaaaaatnnkccggcaattagcaccatcag

SEQ ID NO: 4364 - DNA, 43 bp, Artificial Sequence
  Synthetic
  misc_feature (21)..(22): n is a, c, g, or t
gcatctttgttaaaaatggtnnkgcaattagcaccatcagcaa

SEQ ID NO: 4365 - DNA, 43 bp, Artificial Sequence
  Synthetic
  misc_feature (21)..(22): n is a, c, g, or t
tctttgttaaaaatggtccgnnkattagcaccatcagcaaaga

SEQ ID NO: 4366 - DNA, 43 bp, Artificial Sequence
  Synthetic
  misc_feature (21)..(22): n is a, c, g, or t
ttgttaaaaatggtccggcannkagcaccatcagcaaagatat

SEQ ID NO: 4367 - DNA, 43 bp, Artificial Sequence
  Synthetic
  misc_feature (21)..(22): n is a, c, g, or t
ttaaaaatggtccggcaattnnkaccatcagcaaagatatttt

SEQ ID NO: 4368 - DNA, 43 bp, Artificial Sequence
  Synthetic
  misc_feature (21)..(22): n is a, c, g, or t
aaaatggtccggcaattagcnnkatcagcaaagatatttttgg

SEQ ID NO: 4369 - DNA, 43 bp, Artificial Sequence
  Synthetic
  misc_feature (21)..(22): n is a, c, g, or t
atggtccggcaattagcaccnnkagcaaagatatttttggcga

SEQ ID NO: 4370 - DNA, 43 bp, Artificial Sequence
  Synthetic
  misc_feature (21)..(22): n is a, c, g, or t
gtccggcaattagcaccatcnnkaaagatatttttggcgaatg

SEQ ID NO: 4371 - DNA, 43 bp, Artificial Sequence
  Synthetic
  misc_feature (21)..(22): n is a, c, g, or t
cggcaattagcaccatcagcnnkgatatttttggcgaatggaa

SEQ ID NO: 4372 - DNA, 43 bp, Artificial Sequence
  Synthetic
  misc_feature (21)..(22): n is a, c, g, or t
caattagcaccatcagcaaannkatttttggcgaatggaatgt

SEQ ID NO: 4373 - DNA, 43 bp, Artificial Sequence
  Synthetic
  misc_feature (21)..(22): n is a, c, g, or t
ttagcaccatcagcaaagatnnktttggcgaatggaatgtgat

SEQ ID NO: 4374 - DNA, 43 bp, Artificial Sequence
  Synthetic
  misc_feature (21)..(22): n is a, c, g, or t
gcaccatcagcaaagatattnnkggcgaatggaatgtgatccg

SEQ ID NO: 4375 - DNA, 43 bp, Artificial Sequence
  Synthetic
  misc_feature (21)..(22): n is a, c, g, or t
ccatcagcaaagatatttttnnkgaatggaatgtgatccgcga

SEQ ID NO: 4376 - DNA, 43 bp, Artificial Sequence
  Synthetic
  misc_feature (21)..(22): n is a, c, g, or t
tcagcaaagatatttttggcnnktggaatgtgatccgcgataa

SEQ ID NO: 4377 - DNA, 43 bp, Artificial Sequence
  Synthetic
  misc_feature (21)..(22): n is a, c, g, or t
gcaaagatatttttggcgaannkaatgtgatccgcgataaatg

SEQ ID NO: 4378 - DNA, 43 bp, Artificial Sequence
  Synthetic
  misc_feature (21)..(22): n is a, c, g, or t
aagatatttttggcgaatggnnkgtgatccgcgataaatggaa

SEQ ID NO: 4379 - DNA, 43 bp, Artificial Sequence
  Synthetic
  misc_feature (21)..(22): n is a, c, g, or t
atatttttggcgaatggaatnnkatccgcgataaatggaatgc

SEQ ID NO: 4380 - DNA, 43 bp, Artificial Sequence
  Synthetic
  misc_feature (21)..(22): n is a, c, g, or t
tttttggcgaatggaatgtgnnkcgcgataaatggaatgccga

SEQ ID NO: 4381 - DNA, 43 bp, Artificial Sequence
  Synthetic
  misc_feature (21)..(22): n is a, c, g, or t
ttggcgaatggaatgtgatcnnkgataaatggaatgccgaata

SEQ ID NO: 4382 - DNA, 43 bp, Artificial Sequence
  Synthetic
  misc_feature (21)..(22): n is a, c, g, or t
gcgaatggaatgtgatccgcnnkaaatggaatgccgaatatga

SEQ ID NO: 4383 - DNA, 43 bp, Artificial Sequence
  Synthetic
  misc_feature (21)..(22): n is a, c, g, or t
aatggaatgtgatccgcgatnnktggaatgccgaatatgatga

SEQ ID NO: 4384 - DNA, 43 bp, Artificial Sequence
  Synthetic
  misc_feature (21)..(22): n is a, c, g, or t
ggaatgtgatccgcgataaannkaatgccgaatatgatgatat

SEQ ID NO: 4385 - DNA, 43 bp, Artificial Sequence
  Synthetic
  misc_feature (21)..(22): n is a, c, g, or t
atgtgatccgcgataaatggnnkgccgaatatgatgatatcca

SEQ ID NO: 4386 - DNA, 43 bp, Artificial Sequence
  Synthetic
  misc_feature (21)..(22): n is a, c, g, or t
tgatccgcgataaatggaatnnkgaatatgatgatatccacct

SEQ ID NO: 4387 - DNA, 43 bp, Artificial Sequence
  Synthetic
  misc_feature (21)..(22): n is a, c, g, or t
tccgcgataaatggaatgccnnktatgatgatatccacctgaa

SEQ ID NO: 4388 - DNA, 43 bp, Artificial Sequence
  Synthetic
  misc_feature (21)..(22): n is a, c, g, or t
gcgataaatggaatgccgaannkgatgatatccacctgaaaaa

SEQ ID NO: 4389 - DNA, 43 bp, Artificial Sequence
  Synthetic
  misc_feature (21)..(22): n is a, c, g, or t
ataaatggaatgccgaatatnnkgatatccacctgaaaaaaaa

SEQ ID NO: 4390 - DNA, 43 bp, Artificial Sequence
  Synthetic
  misc_feature (21)..(22): n is a, c, g, or t
aatggaatgccgaatatgatnnkatccacctgaaaaaaaaggc

SEQ ID NO: 4391 - DNA, 43 bp, Artificial Sequence
  Synthetic
  misc_feature (21)..(22): n is a, c, g, or t
ggaatgccgaatatgatgatnnkcacctgaaaaaaaaggccgt

SEQ ID NO: 4392 - DNA, 43 bp, Artificial Sequence
  Synthetic
  misc_feature (21)..(22): n is a, c, g, or t
atgccgaatatgatgatatcnnkctgaaaaaaaaggccgtggt

SEQ ID NO: 4393 - DNA, 43 bp, Artificial Sequence
  Synthetic
  misc_feature (21)..(22): n is a, c, g, or t
ccgaatatgatgatatccacnnkaaaaaaaaggccgtggtgac

SEQ ID NO: 4394 - DNA, 43 bp, Artificial Sequence
  Synthetic
  misc_feature (21)..(22): n is a, c, g, or t
aatatgatgatatccacctgnnkaaaaaggccgtggtgaccga

SEQ ID NO: 4395 - DNA, 43 bp, Artificial Sequence
  Synthetic
  misc_feature (21)..(22): n is a, c, g, or t
atgatgatatccacctgaaannkaaggccgtggtgaccgagaa

SEQ ID NO: 4396 - DNA, 43 bp, Artificial Sequence
  Synthetic
  misc_feature (21)..(22): n is a, c, g, or t
atgatatccacctgaaaaaannkgccgtggtgaccgagaaata

SEQ ID NO: 4397 - DNA, 43 bp, Artificial Sequence
  Synthetic
  misc_feature (21)..(22): n is a, c, g, or t
atatccacctgaaaaaaaagnnkgtggtgaccgagaaatatga

SEQ ID NO: 4398 - DNA, 43 bp, Artificial Sequence
  Synthetic
  misc_feature (21)..(22): n is a, c, g, or t
tccacctgaaaaaaaaggccnnkgtgaccgagaaatatgaaga

SEQ ID NO: 4399 - DNA, 43 bp, Artificial Sequence
  Synthetic
  misc_feature (21)..(22): n is a, c, g, or t
acctgaaaaaaaaggccgtgnnkaccgagaaatatgaagatga

SEQ ID NO: 4400 - DNA, 43 bp, Artificial Sequence
  Synthetic
  misc_feature (21)..(22): n is a, c, g, or t
tgaaaaaaaaggccgtggtgnnkgagaaatatgaagatgatcg

SEQ ID NO: 4401 - DNA, 43 bp, Artificial Sequence
  Synthetic
  misc_feature (21)..(22): n is a, c, g, or t
aaaaaaaggccgtggtgaccnnkaaatatgaagatgatcgtcg

SEQ ID NO: 4402 - DNA, 43 bp, Artificial Sequence
  Synthetic
  misc_feature (21)..(22): n is a, c, g, or t
aaaaggccgtggtgaccgagnnktatgaagatgatcgtcgtaa

SEQ ID NO: 4403 - DNA, 43 bp, Artificial Sequence
  Synthetic
  misc_feature (21)..(22): n is a, c, g, or t
aggccgtggtgaccgagaaannkgaagatgatcgtcgtaaaag

SEQ ID NO: 4404 - DNA, 43 bp, Artificial Sequence
  Synthetic
  misc_feature (21)..(22): n is a, c, g, or t
ccgtggtgaccgagaaatatnnkgatgatcgtcgtaaaagctt

SEQ ID NO: 4405 - DNA, 43 bp, Artificial Sequence
  Synthetic
  misc_feature (21)..(22): n is a, c, g, or t
tggtgaccgagaaatatgaannkgatcgtcgtaaaagcttcaa

SEQ ID NO: 4406 - DNA, 43 bp, Artificial Sequence
  Synthetic
  misc_feature (21)..(22): n is a, c, g, or t
tgaccgagaaatatgaagatnnkcgtcgtaaaagcttcaagaa
